United States Patent 8,586,006 (ORGAN-SPECIFIC PROTEINS AND METHODS OF THEIR USE) - sequence listing, part 15

SEQ ID NO: 26574 - protein, 2696 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGTKSQSLVSSQRPLDRPPAVAGPRPQLSDKPSPVTSPSSSPSVRSQPLERPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLLSQPPAKAFLYEPTTQASGRASAGAEQTPGPLSQSPGLVKQAKQMVGGQQLPALAAKSGQSFRSLGKAPASLPTEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 26575 - protein, 2427 aa, Homo sapiens
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGTKSQSLVSSQRPLDRPPAVAGPRPQLSDKPSPVTSPSSSPSVRSQPLERPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLLSQPPAKAFLYEPTTQASGRASAGAEQTPGPLSQSPGLVKQAKQMVGGQQLPALAAKSGQSFRSLGKAPASLPTEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 26576 - protein, 917 aa, Homo sapiens
MAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGAKISERIQGHTGAVTCIWMNEQCSSIITGGEDRQIIFWKLQY

SEQ ID NO: 26577 - protein, 137 aa, Homo sapiens
MAGSQDIFDAIVMADERFHGEGYREGYEEGSSLGVMEGRQHGTLHGAKIGSEIGCYQGFAFAWKCLLHSCTTEKDSRKMKVLESLIGMIQKFPYDDPTYDKLHEDLDKIRGKFKQFCSLLNVQPDFKISAEGSGLSF

SEQ ID NO: 26578 - protein, 201 aa, Homo sapiens
MALSWVLTVLSLLPLLEAQIPLCANLVPVPITNATLDRITGKWFYIASAFRNEEYNKSVQEIQATFFYFTPNKTEDTIFLREYQTRQNQCFYNSSYLNVQRENGTVSRYEGGREHVAHLLFLRDTKTLMFGSYLDDEKNWGLSFYADKPETTKEQLGEFYEALDCLCIPRSDVMYTDWKKDKCEPLEKQHEKERKQEEGES

SEQ ID NO: 26579 - protein, 422 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 26580 - protein, 397 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQNEGIPDGACSKDSDCHAGEAVTAGNGVKTGRCLRRENLARGTCEIFAWCPLETSSRPEEPFLKEAEDFTIFIKNHIRFPKFNFSNNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 26581 - protein, 178 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPE

SEQ ID NO: 26582 - protein, 339 aa, Homo sapiens
MANLDKYTETFKMGSNSTSTAEIYCNVTNVKFQYSLYATTYILIFIPGLLANSAALWVLCRFISKKNKAIIFMINLSVADLAHVLSLPLRIYYYISHHWPFQRALCLLCFYLKYLNMYASICFLTCISLQRCFFLLKPFRARDWKRRYDVGISAAIWIVVGTACLPFPILRSTDLNNNKSCFADLGYKQMNAVALVGMITVAELAGFVIPVIIIAWCTWKTTISLRQPPMAFQGISERQKALRMVFMCAAVFFICFTPYHINFIFYTMVKETIISSCPVVRIALYFHPFCLCLASLCCLLDPILYYFMASEFRDQLSRHGSSVTRSRLMSKESGSSMIG

SEQ ID NO: 26583 - protein, 339 aa, Homo sapiens; identical to SEQ ID NO: 26582

SEQ ID NO: 26584 - protein, 279 aa, Homo sapiens
MPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 26585 - protein, 570 aa, Homo sapiens
MRRLGPFHPRVHWAAPPSLSSGLHRLLFLRGTRIPSSTTLSPPRHDSLSLDGGTVNPPRVREPTGREAFGPSPASSDWLPARWRNGRGGRPRARLCSGWTAAEEARRNPTLGGLLGRQRLLLRMGGGRLGAPMERHGRASATSVSSAGEQAAGDPEGRRQEPLRRRASSASVPAVGASAEGTRRDRLGSYSGPTSVSRQRVESLRKKRPLFPWFGLDIGGTLVKLVYFEPKDITAEEEEEEVESLKSIRKYLTSNVAYGSTGIRDVHLELKDLTLCGRKGNLHFIRFPTHDMPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 26586 - protein, 279 aa, Homo sapiens; identical to SEQ ID NO: 26584

SEQ ID NO: 26587 - protein, 701 aa, Homo sapiens
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEICQHYNKGDGPHGSCAFQKQCIKLHICQYFLQGECKFGTSCKRSHDFSNSENLEKLEKLGMSSDLVSRLPTIYRNAHDIKNKSSAPSRVPPLFVPQGTSERKDSSGSVSPNTLSQEEGDQICLYHIRKSCSFQDKCHRVHFHLPYRWQFLDRGKWEDLDNMELIEEAYCNPKIERILCSESASTFHSHCLNFNAMTYGATQARRLSTASSVTKPPHFILTTDWIWYWSDEFGSWQEYGRQGTVHPVTTVSSSDVEKAYLAYCTPGSDGQAATLKFQAGKHNYELDFKAFVQKNLVYGTTKKVCRRPKYVSPQDVTTMQTCNTKFPGPKSIPDYWDSSALPDPGFQKITLSSSSEEYQKVWNLFNRTLPFYFVQKIERVQNLALWEVYQWQKGQMQKQNGGKAVDERQLFHGTSAIFVDAICQQNFDWRVCGVHGTSYGKGSYFARDAAYSHHYSKSDTQTHTMFLARVLVGEFVRGNASFVRPPAKEGWSNAFYDSCVNSVSDPSIFVIFEKHQVYPEYVIQYTTSSKPSVTPSILLALGSLFSSRQ

SEQ ID NO: 26588 - protein, 444 aa, Homo sapiens
MLQRIGLIFLHNIVVVSNCFYFQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 26589 - protein, 1035 aa, Homo sapiens
MVFLQNHVRFFLESLPAFLRVLIQAGALCWSLPELSQGEVGKGACPAEVGKHRDHLPSSDPVLMQAEASVVMCWVSSEDRSALWALVTFYGGDCQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 26590 - protein, 356 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAVGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 26591 - protein, 214 aa, Homo sapiens
MELAAGSFSEEQFWEACAELQQPALAGADWQLLVETSGISIYRLLDKKTGLHEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 26592 - protein, 407 aa, Homo sapiens
MRWVWALLKNASLAGAPKYIEHFSKFSPSPLSMKQFLDFGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 26593 - protein, 241 aa, Homo sapiens
MASLSGLASALESYRGRDRLIRVLGYCCQLVGGVLVEQCPARSEVGTRLLVVSTQLSHCRTILRLFDDLAMFVYTKQYGLGAQEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 26594 - protein, 809 aa, Homo sapiens
MYEALPGPAPENEDGLVKVKEEDPTWEQVCNSQEGSSHTQEICRLRFRHFCYQEAHGPQEALAQLRELCHQWLRPEMHTKEQIMELLVLEQFLTILPKELQPCVKTYPLESGEEAVTVLENLETGSGDTGQQASVYIQGQDMHPMVAEYQGVSLECQSLQLLPGITTLKCEPPQRPQGNPQEVSGPVPHGSAHLQEKNPRDKAVVPVFNPVRSQTLVKTEEETAQAVAAEKWSHLSLTRRNLCGNSAQETVMSLSPMTEEIVTKDRLFKAKQETSEEMEQSGEASGKPNRECAPQIPCSTPIATERTVAHLNTLKDRHPGDLWARMHISSLEYAAGDITRKGRKKDKARVSELLQGLSFSGDSDVEKDNEPEIQPAQKKLKVSCFPEKSWTKRDIKPNFPSWSALDSGLLNLKSEKLNPVELFELFFDDETFNLIVNETNNYASQKNVSLEVTVQEMRCVFGVLLLSGFMRHPRREMYWEVSDTDQNLVRDAIRRDRFELIFSNLHFADNGHLDQKDKFTKLRPLIKQMNKNFLLYAPLEEYYCFDKSMCECFDSDQFLNGKPIRIGYKIWCGTTTQGYLVWFEPYQEESTMKVDEDPDLGLGGNLVMNFADVLLERGQYPYHLCFDSFFTSVKLLSALKKKGVRATGTIRENRTEKCPLMNVEHMKKMKRGYFDFRIEENNEIILCRWYGDGIISLCSNAVGIEPVNEVSCCDADNEEIPQISQPSIVKVYDECKEGVAKMDQIISKYRVRIRSKKWYSILVSYMIDVAMNNAWQLHRACNPGASLDPLDFRRFVAHFYLEHNAHLSD

SEQ ID NO: 26595 - protein, 933 aa, Homo sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDSSESEESAGPLLKGKPRALGGAAAGGGAAACPPGAAAGGVALVPKEDSRFSAPRVALVEQDAPMAPGRSPLATTVMDFIHVPILPLNHALLAARTRQLLEDESYDGGAGAASAFAPPRTSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPLGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 26596 - protein, 634 aa, Homo sapiens
MDNAVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKENTENHSETPAAPALPPSAPPKPRSKPKPKKSPVPPKGATAGASHKGDEVPPIKKNTKAPGKQAPVPPPKPASRNTTREAAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 26597 - protein, 2039 aa, Homo sapiens
MDIVDTFNHLIPTEHLDDALFLGSNLENEVCEDFSASQNVLEDSLKNMLSDKDPMLGSASNQFCLPVLDSNDPNFQMPCSTVVGLDDIMDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 26598 - protein, 785 aa, Homo sapiens
MAPKVTDAIVWYQKKEFLSVATTAPGPQQVLPGYCQCSLKDQGLFIQCLIGAYDQQIWEKSVEQREIKFIKLGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 26599 - protein, 484 aa, Homo sapiens
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRYIFVRERVTIIHSHSSFSAMAHDALFHAKTMGLQTVFTDHSLFGFADVSSVLTNKLLTVSLCDTNHIICVSYTSKENTVLRAALNPEIVSVIPNAVDPTDFTPDPFRRHDSITIVVVSRLVYRKGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 26600 - protein, 416 aa, Homo sapiens
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEFLAQLKIMDYSLLVGIHDVDRAEQEEMEVEERAEDEECENDGVGGNLLCSYGTPPDSPGNLLSFPRFFGPGEFDPSVDVYAMKSHESSPKKEVYFMAIIDILTPYDTKKKAAHAAKTVKHGAGAEISTVNPEQYSKRFNEFMSNILT

SEQ ID NO: 26601 - protein, 281 aa, Homo sapiens
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEEILVLSPGWRIA

SEQ ID NO: 26602 - protein, 145 aa, Homo sapiens
MELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSDKGSWCEQQLCACDKEVAFCLKRNLDTYQKRLRFYWRPHCRGQTPGC

SEQ ID NO: 26603 - protein, 1390 aa, Homo sapiens
MVKEQFRETDVAKKISHICFGMKSPEEMRQQAHIQVVSKNLYSQDNQHAPLLYGVLDHRMGTSEKDRPCETCGKNLADCLGHYGYIDLELPCFHVGYFRAVIGILQMICKTCCHIMLSQEEKKQFLDYLKRPGLTYLQKRGLKKKISDKCRKKNICHHCGAFNGTVKKCGLLKIIHEKYKTNKKVVDPIVSNFLQSFETAIEHNKEVEPLLGRAQENLNPLVVLNLFKRIPAEDVPLLLMNPEAGKPSDLILTRLLVPPLCIRPSVVSDLKSGTNEDDLTMKLTEIIFLNDVIKKHRISGAKTQMIMEDWDFLQLQCALYINSELSGIPLNMAPKKWTRGFVQRLKGKQGRFRGNLSGKRVDFSGRTVISPDPNLRIDEVAVPVHVAKILTFPEKVNKANINFLRKLVQNGPEVHPGANFIQQRHTQMKRFLKYGNREKMAQELKYGDIVERHLIDGDVVLFNRQPSLHKLSIMAHLARVKPHRTFRFNECVCTPYNADFDGDEMNLHLPQTEEAKAEALVLMGTKANLVTPRNGEPLIAAIQDFLTGAYLLTLKDTFFDRAKACQIIASILVGKDEKIKVRLPPPTILKPVTLWTGKQIFSVILRPSDDNPVRANLRTKGKQYCGKGEDLCANDSYVTIQNSELMSGSMDKGTLGSGSKNNIFYILLRDWGQNEAADAMSRLARLAPVYLSNRGFSIGIGDVTPGQGLLKAKYELLNAGYKKCDEYIEALNTGKLQQQPGCTAEETLEALILKELSVIRDHAGSACLRELDKSNSPLTMALCGSKGSFINISQMIACVGQQAISGSRVPDGFENRSLPHFEKHSKLPAAKGFVANSFYSGLTPTEFFFHTMAGREGLVDTAVKTAETGYMQRRLVKSLEDLCSQYDLTVRSSTGDIIQFIYGGDGLDPAAMEGKDEPLEFKRVLDNIKAVFPCPSEPALSKNELILTTESIMKKSEFLCCQDSFLQEIKKFIKGVSEKIKKTRDKYGINDNGTTEPRVLYQLDRITPTQVEKFLETCRDKYMRAQMEPGSAVGALCAQSIGEPGTQMTLKTFHFAGVASMNITLGVPRIKEIINASKAISTPIITAQLDKDDDADYARLVKGRIEKTLLGEISEYIEEVFLPDDCFILVKLSLERIRLLRLEVNAETVRYSICTSKLRVKPGDVAVHGEAVVCVTPRENSKSSMYYVLQFLKEDLPKVVVQGIPEVSRAVIHIDEQSGKEKYKLLVEGDNLRAVMATHGVKGTRTTSNNTYEVEKTLGIEAARTTIINEIQYTMVNHGMSIDRRHVMLLSDLMTYKGEVLGITRFGLAKMKESVLMLASFEKTADHLFDAAYFGQKDSVCGVSECIIMGIPMNIGTGLFKLLHKADRDPNPPKRPLIFDTNEFHIPLVT

SEQ ID NO: 26604 - protein, 1202 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 26605 - protein, 1185 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGM

SEQ ID NO: 26606 - protein, 170 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQVCAEARTKMGFPC

SEQ ID NO: 26607 - protein, 713 aa, Homo sapiens
MEPGTGGSRKRLGPRAGFRFWPPFFPRRSQAGSSKFPTPLGPENSGNPTLLSSAQPETRVSYWTKLLSQLLAPLPGLLQKVLIWSQLFGGMFPTRWLDFAGVYSALRALKGREKPAAPTAQKSLSSLQLDSSDPSVTSPLDWLEEGIHWQYSPPDLKLELKAKGSALDPAAQAFLLEQQLWGVELLPSSLQSRLYSNRELGSSPSGPLNIQRIDNFSVVSYLLNPSYLDCFPRLEVSYQNSDGNSEVVGFQTLTPESSCLREDHCHPQPLSAELIPASWQGCPPLSTEGLPEIHHLRMKRLEFLQQASKGQDLPTPDQDNGYHSLEEEHSLLRMDPKHCRDNPTQFVPAAGDIPGNTQESTEEKIELLTTEVPLALEEESPSEGCPSSEIPMEKEPGEGRISVVDYSYLEGDLPISARPACSNKLIDYILGGASSDLETSSDPEGEDWDEEAEDDGFDSDSSLSDSDLEQDPEGLHLWNSFCSVDPYNPQNFTATIQTAARIVPEEPSDSEKDLSGKSDLENSSQSGSLPETPEHSSGEEDDWESSADEAESLKLWNSFCNSDDPYNPLNFKAPFQTSGENEKGCRDSETPSESIVAISECHTLLSCKVQLLGSQESECPDSVQRDVLSGGRHTHVKRKKVTFLEEVTEYYISGDEDRKGPWEEFARDGCRFQKRIQETEDAIGYCLTFEHRERMFNRLQGTCFKGLNVLKQC

SEQ ID NO: 26608 - protein, 305 aa, Homo sapiens
MAPLDLDKYVEIARLCKYLPENDLKRLCDYVCDLLLEESNVQPVSTPVTVCGDIHGQFYDLCELFRTGGQVPDTNYIFMGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 26609 - protein, 257 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKNF

SEQ ID NO: 26610 - protein, 855 aa, Homo sapiens
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGTLCVLYAEGQENRCEMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 26611 - protein, 419 aa, Homo sapiens
MGPLSAPPCTQHITWKGLLLTASLLNFWNPPTTAQVTIEAQPPKVSEGKDVLLLVHNLPQNLTGYIWYKGQIRDLYHYVTSYVVDGQIIKYGPAYSGRETVYSNASLLIQNVTQEDTGSYTLHIIKRGDGTGGVTGRFTFTLYLETPKPSISSSNFNPREATEAVILTCDPETPDASYLWWMNGQSLPMTHSLQLSETNRTLYLFGVTNYTAGPYECEIRNPVSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYHSGQNLYLSCFADSNPPAQYSWTINGKFQLSGQKLSIPQITTKHSGLYACSVRNSATGKESSKSVTVRVSDWTLP

SEQ ID NO: 26612 - protein, 272 aa, Homo sapiens
MLIGTPTPRDTTPSSWLTSSLLVEAAPLDDTTLPTPVSSGCPGLEPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 26613 - protein, 276 aa, Homo sapiens
MALLDVCGAPRGQRPESALPVAGSGRRSDPGHYSFSMRSPELALPRGMQPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 26614 - protein, 440 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 26615 - protein, 433 aa, Homo sapiens
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 26616 - protein, 389 aa, Homo sapiens
MPLENLEEEGLPKNPDLRIAQLRFLLSLPEHRGDAAVRDELMAAVRDNNMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 26617 - protein, 225 aa, Homo sapiens
MVSHSELRKLFYSADAVCFDVDSTVIREEGIDELAKICGVEDAVSEMTRRAMGGAVPFKAALTERLALIQPSREQVQRLIAEQPPHLTPGIRELVSRLQERNVQVFLISGGFRSIVEHVASKLNIPATNVFANRLKFYFNGEYAGFDETQPTAESGGKGKVIKLLKEKFHFKKIIMIGDGATDMEACPPADAFIGFGGNVIRQQVKDNAKWYITDFVELLGELEE

SEQ ID NO: 26618 - protein, 312 aa, Homo sapiens
MADGDSGSERGGGGGPCGFQPASRGGGEQETQELASKRLDIQNKRFYLDVKQNAKGRFLKIAEVGAGGSKSRLTLSMAVAAEFRDSLGDFIEHYAQLGPSSPEQLAAGAEEGGGPRRALKSEFLVRENRKYYLDLKENQRGRFLRIRQTVNRGGGGFGAGPGPGGLQSGQTIALPAQGLIEFRDALAKLIDDYGGEDDELAGGPGGGAGGPGGGLYGELPEGTSITVDSKRFFFDVGCNKYGVFLRVSEVKPSYRNAITVPFKAWGKFGGAFCRYADEMKEIQERQRDKLYERRGGGSGGGEESEGEEVDED

SEQ ID NO: 26619 - protein, 847 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 26620 - protein, 185 aa, Homo sapiens
MDAAEVEFLAEKELVTIIPNFSLDKIYLIGGDLGPFNPGLPVEVPLWLAINLKQRQKCRLLPPEWMDVEKLEKMRDHERKEETFTPMPSPYYMELTKLLLNHASDNIPKADEIRTLVKDMWDTRIAKLRVSADSFVRQQEAHAKLDNLTLMEINTSGTFLTQALNHMYKLRTNLQPLESTQSQDF

SEQ ID NO: 26621 - protein, 244 aa, Homo sapiens
MAAAAAAGEARRVLVYGGRGALGSRCVQAFRARNWWVASVDVVENEEASATIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 26622 - protein, 719 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 26623 - protein, 228 aa, Homo sapiens
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWVRKT

SEQ ID NO: 26624 - protein, 294 aa, Homo sapiens
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWKTNDDTIDFDYTVLLHELSTQEIIPCRIHLVWYPGKPLKVKYHCQELQTPEEASGTEEGSAVVPTELSNF

SEQ ID NO: 26625 - protein, 1139 aa, Homo sapiens
MPSGGDQSPPPPPPPPAAAASDEEEEDDGEAEDAAPSAESPTPQIQQRFDELCSRLNMDEAARPEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 26626 - protein, 717 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHLLKEPSSQLFSKPEVIKQKYETGPCSKADVVDSETVVRARGLPWQSSDQDVARFFKGLNVARGGVALCLNAQGRRNGEALIRFVDSEQRDLALQRHKHHMGVRYIEVYKATGEEFVKIAGGTSLEVARFLSREDQVILRLRGLPFSAGPTDVLGFLGPECPVTGGTEGLLFVRHPDGRPTGDAFALFACEELAQAALRRHKGMLGKRYIELFRSTAAEVQQVLNRYASGPLLPTLTAPLLPIPFPLAPGTGRDCVRLRGLPYTATIEDILSFLGEAAADIRPHGVHMVLNQQGRPSGDAFIQMTSAERALAAAQRCHKKVMKERYVEVVPCSTEEMSRVLMGGTLGRSGMSPPPCKLPCLSPPTYTTFQATPTLIPTETAALYPSSALLPAARVPAAPTPVAYYPGPATQLYLNYTAYYPSPPVSPTTVGYLTTPTAALASAPTSVLSQSGALVRMQGVPYTAGMKDLLSVFQAYQLPADDYTSLMPVGDPPRTVLQAPKEWVCL

SEQ ID NO: 26627 - protein, 135 aa, Homo sapiens
MPPNLTGYYRFVSQKNMEDYLQALNISLAVRKIALLLKPDKEIEHQGNHMTVRTLSTFRNYTVQFDVGVEFEEDLRSVDGRKCQTIVTWEEEHLVCVQKGEVPNRGWRHWLEGEMLYLELTARDAVCEQVFRKVR

SEQ ID NO: 26628 - protein, 196 aa, Homo sapiens
MPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 26629 - protein, 292 aa, Homo sapiens
MTTTRYRPTWDLALDPLVSCKLCLGEYPVEQMTTIAQCQCIFCTLCLKQYVELLIKEGLETAISCPDAACPKQGHLQENEIECMVAAEIMQRYKKLQFEREVLFDPCRTWCPASTCQAVCQLQDVGLQTPQPVQCKACRMEFCSTCKASWHPGQGCPETMPITFLPGETSAAFKMEEDDAPIKRCPKCKVYIERDEGCAQMMCKNCKHAFCWYCLESLDDDFLLIHYDKGPCRNKLGHSRASVIWHRTQVVGIFAGFGLLLLVASPFLLLATPFVLCCKCKCSKGDDDPLPT

SEQ ID NO: 26630 - protein, 459 aa, Homo sapiens
MAASASAAAGEEDWVLPSEVEVLESIYLDELQVIKGNGRTSPWEIYITLHPATAEDQDSQYVCFTLVLQVPAEYPHEVPQISIRNPRGLSDEQIHTILQVLGHVAKAGLGTAMLYELIEKGKEILTDNNIPHGQCVICLYGFQEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQRLGETQKAMLDPPKPSRGPWRQPERRHPKGGECHAPKGTRDTQELPPPEGPLKEPMDLKPEPHSQGVEGPPQEKGPGSWQGPPPRRTRDCVRWERSKGRTPGSSYPRLPRGQGAYRPGTRRESLGLESKDGS

SEQ ID NO: 26631 - protein, 341 aa, Homo sapiens
MEEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 26632 - protein, 500 aa, Homo sapiens
MEVSTNPSSNIDPGDYVEMNDSITHLPSKVVIQDITMELHCPLCNDWFRDPLMLSCGHNFCEACIQDFWRLQAKETFCPECKMLCQYNNCTFNPVLDKLVEKIKKLPLLKGHPQCPEHGENLKLFSKPDGKLICFQCKDARLSVGQSKEFLQISDAVHFFTEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 26633 - protein, 622 aa, Homo sapiens
MAAAVQPAEVTVEVGEDLHMHQVRDREMPEALEFNLSANPEASTIFQRNSQTDALEFNPSANPEASTIFQRNSQTDVVEIRRSNCTNRVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPICKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQSEAMALQSIQNMRGNAHCVDCETQNPKWASLNLGVLMCIECSGIHRSLGTRLSRVRSLELDDWPVELRKVMSSIGNELANSIWEGSSQGQTKPSIKSTREEKERWIHSKYEEKLFLAPLPCTELSLGQQLLRATADEDLQTAILLLAHGSREEVNETCGEGDGCTALHLACRKGNVVLEQLLIWYGVDVMARDAHGNTALTYARQASSQECINVLLQYGCPDECV

SEQ ID NO: 26634 - protein, 485 aa, Homo sapiens
MKKRNGGGSLNNYSSSIPPTPSTSQEDPQFSVPPTANTPTPICKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNELANSIWEGSSQGQTKPSIKSTREEKERWIHSKYEEKLFLAPLPCTELSLGQQLLRATADEDLQTAILLLAHGSREEVNETCGEGDGCTALHLACRKGNVVLEQLLIWYGVDVMARDAHGNTALTYARQASSQECINVLLQYGCPDECV

SEQ ID NO: 26635 - protein, 528 aa, Homo sapiens
MNFFSFHSVTLEIPHHITQRDADRSLSIPDEQLHSFAVSTVHIMKKRNGGGSLNNYSSSIPPTPSTSQEDPQFSVPPTANTPTPICKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNELANSIWEGSSQGQTKPSIKSTREEKERWIHSKYEEKLFLAPLPCTELSLGQQLLRATADEDLQTAILLLAHGSREEVNETCGEGDGCTALHLACRKGNVVLEQLLIWYGVDVMARDAHGNTALTYARQASSQECINVLLQYGCPDECV

SEQ ID NO: 26636 - protein, 145 aa, Homo sapiens
  VARIANT 25, 27, 30, 34, 50, 54, 57, 66, 71, 76, 99, 131: Xaa = Any Amino Acid
MSSKSGSLSVSLEFDPAAGVGVSLXIXDLXGRSXGQDGRSAHGCCCTACXGDCXSWXGPPHAPGSXPGDAXSFGVXPFCQSRGKHNIPEELSNRCFGVXPFCQSRGKHNIPEELSNRCCRNKKKQLYKPLXPWRYLIISHKEMQI

SEQ ID NO: 26637 - protein, 485 aa, Homo sapiens; identical to SEQ ID NO: 26634

SEQ ID NO: 26638 - protein, 687 aa, Homo sapiens
  VARIANT 28, 30, 33, 37, 53, 57, 60, 69, 74, 79, 102, 136, 151, 152,182, 188, 189, 213, 257, 261, 274, 285, 321, 328, 332, 359,373, 399, 424, 429, 453, 463, 483, 488, 501, 523, 527, 538,572, 584, 597, 598, 613: Xaa = Any Amino Acid
MGNILTCRVHPSVSLEFDPAAGVGVSLXIXDLXGRSXGQDGRSAHGCCCTACXGDCXSWXGPPHAPGSXPGDAXSFGVXPFCQSRGKHNIPEELSNRCFGVXPFCQSRGKHNIPEELSNRCCRNKKKQLYKPCIYXAFQSTIQLVFDNIPXXQHSHPALSYNDNNICDLGDTSSYHTKRCRXIFEHTXXTVTLICGFHRAHYEEKKWRWEFKXLFLLHSTDSQHQPGGPSVQCSSHCQHTHPHLQAVHALVQPVYIXEREXPRQREESPGESCXHHRERQSHPHXTGHALKAKWEMAEDMEKEIRHPVFQWRAHLLFKLRXLYEEYSXKRDXPSDIYHQSPRKVAIPSHISLCTHLQLXKQWPIQGHGHRAGXLHMLQPQYLQHHQPQAQPTPLSSCQXKETPKEEKHQQLYDCVCHWPNVALXSHDVXGAGCLGPSHPEPDPGQPAVMREQXKQVPADQPEXGHGPAVDPKHAWERPLCGLXDPESXVGQFELGSPHVYXMLRYPPQSWHPPFPCAISGAGXLASXAQEGYVIYWQXASQQHLGREQPGADKTLNKVHEGREGTLDPFQIXGEALSGPTTLHXAVSGPAAAAGHRXXGPADSHPAAGTWLPXGGERDLWGGRRLHGTPSGLPQGECGPGAAPDLVRGGRHGPRCPREHSADLRPAGLQPGVHQRASAVRLPRRVRV

SEQ ID NO: 26639 - protein, 148 aa, Homo sapiens
  VARIANT 28, 30, 33, 37, 53, 57, 60, 69, 74, 79, 102, 134: Xaa = Any Amino Acid
MGNILTCRVHPSVSLEFDPAAGVGVSLXIXDLXGRSXGQDGRSAHGCCCTACXGDCXSWXGPPHAPGSXPGDAXSFGVXPFCQSRGKHNIPEELSNRCFGVXPFCQSRGKHNIPEELSNRCCRNKKKQLYKPLXPWRYLIISHKEMQI

SEQ ID NO: 26640 - protein, 212 aa, Homo sapiens
  VARIANT 28, 30, 33, 37, 53, 57, 60, 69, 74, 79, 102, 136, 151, 152,182, 188, 189, 207: Xaa = Any Amino Acid
MGNILTCRVHPSVSLEFDPAAGVGVSLXIXDLXGRSXGQDGRSAHGCCCTACXGDCXSWXGPPHAPGSXPGDAXSFGVXPFCQSRGKHNIPEELSNRCFGVXPFCQSRGKHNIPEELSNRCCRNKKKQLYKPCIYXAFQSTIQLVFDNIPXXQHSHPALSYNDNNICDLGDTSSYHTKRCRXIFEHTXXTVTLICDRVSPCWPGWSXTPDLV

SEQ ID NO: 26641 - protein, 578 aa, Homo sapiens
MLWSLTLLPIQRQAQYSRGTLKQMVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPICKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNELANSIWEGSSQGQTKPSIKSTREEKERWIHSKYEEKLFLAPLPCTELSLGQQLLRATADEDLQTAILLLAHGSREEVNETCGEGDGCTALHLACRKGNVVLEQLLIWYGVDVMARDAHGNTALTYARQASSQECINVLLQYGCPDECV

SEQ ID NO: 26642 - protein, 684 aa, Homo sapiens
  VARIANT 25, 27, 30, 34, 50, 54, 57, 66, 71, 76, 99, 133, 148, 149,179, 185, 186, 210, 254, 258, 271, 282, 318, 325, 329, 356,370, 396, 421, 426, 450, 460, 480, 485, 498, 520, 524, 535,569, 581, 594, 595, 610: Xaa = Any Amino Acid
MSSKSGSLSVSLEFDPAAGVGVSLXIXDLXGRSXGQDGRSAHGCCCTACXGDCXSWXGPPHAPGSXPGDAXSFGVXPFCQSRGKHNIPEELSNRCFGVXPFCQSRGKHNIPEELSNRCCRNKKKQLYKPCIYXAFQSTIQLVFDNIPXXQHSHPALSYNDNNICDLGDTSSYHTKRCRXIFEHTXXTVTLICGFHRAHYEEKKWRWEFKXLFLLHSTDSQHQPGGPSVQCSSHCQHTHPHLQAVHALVQPVYIXEREXPRQREESPGESCXHHRERQSHPHXTGHALKAKWEMAEDMEKEIRHPVFQWRAHLLFKLRXLYEEYSXKRDXPSDIYHQSPRKVAIPSHISLCTHLQLXKQWPIQGHGHRAGXLHMLQPQYLQHHQPQAQPTPLSSCQXKETPKEEKHQQLYDCVCHWPNVALXSHDVXGAGCLGPSHPEPDPGQPAVMREQXKQVPADQPEXGHGPAVDPKHAWERPLCGLXDPESXVGQFELGSPHVYXMLRYPPQSWHPPFPCAISGAGXLASXAQEGYVIYWQXASQQHLGREQPGADKTLNKVHEGREGTLDPFQIXGEALSGPTTLHXAVSGPAAAAGHRXXGPADSHPAAGTWLPXGGERDLWGGRRLHGTPSGLPQGECGPGAAPDLVRGGRHGPRCPREHSADLRPAGLQPGVHQRASAVRLPRRVRV

SEQ ID NO: 26643 - protein, 664 aa, Homo sapiens
  VARIANT 28, 30, 33, 37, 53, 57, 60, 69, 74, 79, 113, 128, 129, 159,165, 166, 190, 234, 238, 251, 262, 298, 305, 309, 336, 350,376, 401, 406, 430, 440, 460, 465, 478, 500, 504, 515, 549,561, 574, 575, 590: Xaa = Any Amino Acid
MGNILTCRVHPSVSLEFDPAAGVGVSLXIXDLXGRSXGQDGRSAHGCCCTACXGDCXSWXGPPHAPGSXPGDAXSFGVXPFCQSRGKHNIPEELSNRCCRNKKKQLYKPCIYXAFQSTIQLVFDNIPXXQHSHPALSYNDNNICDLGDTSSYHTKRCRXIFEHTXXTVTLICGFHRAHYEEKKWRWEFKXLFLLHSTDSQHQPGGPSVQCSSHCQHTHPHLQAVHALVQPVYIXEREXPRQREESPGESCXHHRERQSHPHXTGHALKAKWEMAEDMEKEIRHPVFQWRAHLLFKLRXLYEEYSXKRDXPSDIYHQSPRKVAIPSHISLCTHLQLXKQWPIQGHGHRAGXLHMLQPQYLQHHQPQAQPTPLSSCQXKETPKEEKHQQLYDCVCHWPNVALXSHDVXGAGCLGPSHPEPDPGQPAVMREQXKQVPADQPEXGHGPAVDPKHAWERPLCGLXDPESXVGQFELGSPHVYXMLRYPPQSWHPPFPCAISGAGXLASXAQEGYVIYWQXASQQHLGREQPGADKTLNKVHEGREGTLDPFQIXGEALSGPTTLHXAVSGPAAAAGHRXXGPADSHPAAGTWLPXGGERDLWGGRRLHGTPSGLPQGECGPGAAPDLVRGGRHGPRCPREHSADLRPAGLQPGVHQRASAVRLPRRVRV

SEQ ID NO: 26644 - protein, 687 aa, Homo sapiens; identical to SEQ ID NO: 26638
  VARIANT 28, 30, 33, 37, 53, 57, 60, 69, 74, 79, 102, 136, 151, 152,182, 188, 189, 213, 257, 261, 274, 285, 321, 328, 332, 359,373, 399, 424, 429, 453, 463, 483, 488, 501, 523, 527, 538,572, 584, 597, 598, 613: Xaa = Any Amino Acid

SEQ ID NO: 26645 - protein, 84 aa, Homo sapiens
MPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 26646 - protein, 587 aa, Homo sapiens
MATAAYEQLKLHITPEKFYVEACDDGADDVLTIDRVSTEVTLAVKKDVPPSAVTRPIFGILGTIHLVAGNYLIVITKKIKVGEFFSHVVWKATDFDVLSYKKTMLHLTDIQLQDNKTFLAMLNHVLNVDGFYFSTTYDLTHTLQRLSNTSPEFQEMSLLERADQRFVWNGHLLRELSAQPEVHRFALPVLHGFITMHSCSINGKYFDWILISRRSCFRAGVRYYVRGIDSEGHAANFVETEQIVHYNGSKASFVQTRGSIPVFWSQRPNLKYKPLPQISKVANHMDGFQRHFDSQVIIYGKQVIINLINQKGSEKPLEQTFATMVSSLGSGMMRYIAFDFHKECKNMRWDRLSILLDQVAEMQDELSYFLVDSAGRVVANQEGVFRSNCMDCLDRTNVIQSLLARRSLQAQLQRLGVLHVGQKLEEQDEFEKIFKNAWADNANACAKQYAGTGALKTDFTRTGKRTHLGLIMDGWNSMIRYYKNNFSDGFRQDSIDLFLGNYSVDELESHSPLSVPRDWKFLALPIIMVVAFSMCIICLLMAGDTWTETLAYVLFWGVASIGTFFIILYNGKDFVDAPRLVQKEKID

SEQ ID NO: 26647 - protein, 373 aa, Homo sapiens
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 26648 - protein, 179 aa, Homo sapiens
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 26649 - protein, 777 aa, Homo sapiens
MNANKDERLKARSQDFHLFPALMMLSMTMLFLPVTGTLKQNIPRLKLTYKDLLLSNSCIPFLGSSEGLDFQTLLLDEERGRLLLGAKDHIFLLSLVDLNKNFKKIYWPAAKERVELCKLAGKDANTECANFIRVLQPYNKTHIYVCGTGAFHPICGYIDLGVYKEDIIFKLDTHNLESGRLKCPFDPQQPFASVMTDEYLYSGTASDFLGKDTAFTRSLGPTHDHHYIRTDISEHYWLNGAKFIGTFFIPDTYNPDDDKIYFFFRESSQEGSTSDKTILSRVGRVCKNDVGGQRSLINKWTTFLKARLICSIPGSDGADTYFDELQDIYLLPTRDERNPVVYGVFTTTSSIFKGSAVCVYSMADIRAVFNGPYAHKESADHRWVQYDGRIPYPRPGTCPSKTYDPLIKSTRDFPDDVISFIKRHSVMYKSVYPVAGGPTFKRINVDYRLTQIVVDHVIAEDGQYDVMFLGTDIGTVLKVVSISKEKWNMEEVVLEELQIFKHSSIILNMELSLKQQQLYIGSRDGLVQLSLHRCDTYGKACADCCLARDPYCAWDGNACSRYAPTSKRRARRQDVKYGDPITQCWDIEDSISHETADEKVIFGIEFNSTFLECIPKSQQATIKWYIQRSGDEHREELKPDERIIKTEYGLLIRSLQKKDSGMYYCKAQEHTFIHTIVKLTLNVIENEQMENTQRAEHEEGKVKDLLAESRLRYKDYIQILSSPNFSLDQYCEQMWHREKRRQRNKGGPKWKHMQEMKKKRNRRHHRDLDELPRAVAT

SEQ ID NO: 26650 - protein, 501 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 26651 - protein, 561 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPLDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 26652 - protein, 594 aa, Homo sapiens
MLPRTKYNRFRNDSVTSVDDLLHSLSVSGGGGKVSAARATPAAAPYLVSGEALRKAPVDGPGSLGHLLHKVSHLKLSSSGLRGLSSAARERAGARLSGSCSAPSLAAPDGSAPSAPRAPAMSAARKGRPGDEPLPRPPRGAPHASDQVLGPGVTYVVKYLGCIEVLRSMRSLDFSTRTQITREAISRVCEAVPGAKGAFKKRKPPSKMLSSILGKSNLQFAGMSISLTISTASLNLRTPDSKQIIANHHMRSISFASGGDPDTTDYVAYVTKDPVNRRACHILECCDGLAQDVIGSIGQAFELRFKQYLQCPTKIPALHDRMQSLDEPWTEEEGDGSDHPYYNSIPSKMPPPGGFLDTRLKPRPHAPDTAQFAGKEQTYYQGRHLGDTFGEDWQQTPLRQGSSDIYSTPEGKLHVAPTGEAPTYVNTQQIPPQAWPAAVSSAESSPRKDLFDMKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTIQTKDRVFDSISHLINHHLESSLPIVSAGSELCLQQPVERKQ

SEQ ID NO: 26653 - protein, 467 aa, Homo sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTALTHRPNILIPGTLESGCFQNLTCSVPWACEQGTPPMISWMGTSVSPLHPSTTRSSVLTLIPQPQHHGTSLTCQVTLPGAGVTTNRTIQLNVSYPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 26654 - protein, 316 aa, Homo sapiens
MLLLLLLPLLWGRERVEGQKSNRKDYSLTMQSSVTVQEGMCAHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTDPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSALRVT

SEQ ID NO: 26655 - protein, 626 aa, Homo sapiens
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEESNADLTTLMHNENLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLSETLHINPLYTLIPVTMCISFAVMLPVGNPPNAIVFSYGHCQIKDMVKAGLGVNVIGLVIVMVAINTWGVSLFHLDTYPAWARVSNITDQA

SEQ ID NO: 26656 - protein, 299 aa, Homo sapiens
MSAKPEVSLVREASRQIVAGGSAGLVEICLMHPLDVVKTRFQIQRCATDPNSYKSLVDSFRMIFQMEGLFGFYKGILPPILAETPKRAVKFFTFEQYKKLLGYVSLSPALTFAIAGLGSGLTEAIVVNPFEVVKVGLQANRNTFAEQPSTVGYARQIIKKEGWGLQGLNKGLTATLGRHGVFNMVYFGFYYNVKNMIPVNKDPILEFWRKFGIGLLSGTIASVINIPFDVAKSRIQGPQPVPGEIKYRTCFKTMATVYQEEGILALYKGLLPKIMRLGPGGAVMLLVYEYTYSWLQENW

SEQ ID NO: 26657 - protein, 361 aa, Homo sapiens
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 26658 - protein, 362 aa, Homo sapiens
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 26659 - protein, 361 aa, Homo sapiens; identical to SEQ ID NO: 26657

SEQ ID NO: 26660 - protein, 122 aa, Homo sapiens
MFSSVAHLARANPFNTPHLQLVHDGLGDLRSSSPGPTGQPRRPRNLAAAAVEGEIRPCPIQSCGLLVGRPAFEAWTRLGGQGRTSPARCTVGRRPVACPGVSAFSTIGGCQILGLPSRAWKR

SEQ ID NO: 26661 - protein, 744 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 26662 - protein, 685 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAFIQR

SEQ ID NO: 26663 - protein, 516 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSFHTEMTRRWRP

SEQ ID NO: 26664 - protein, 335 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGFHTEMTRRWRP

SEQ ID NO: 26665 - protein, 401 aa, Homo sapiens
MDLTQQAKDIQNITVQETNKNNSESIECSKITMDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGVVLISLALCADAVIGNVQEKAMKLHNASNSEMVLYSYSIGFVYILLGLTCTSGLGPAVTFCAKNPVRTYGYAFLFSLTGYFGISFVLALIKIFGALIAVTVTTGRKAMTIVLSFIFFAKPFTFQYVWSGLLVVLGIFLNVYSKNMDKIRLPSLYDLINKSVEARKSRTLAQTV

SEQ ID NO: 26666 - protein, 643 aa, Homo sapiens
MGLLPKLGVSQGSDTSTSRAGRCARSVFGNIKVFVLCQGLLQLCQLLYSAYFKSSLTTIEKRFGLSSSSSGLISSLNEISNAILIIFVSYFGSRVHRPRLIGIGGLFLAAGAFILTLPHFLSEPYQYTLASTGNNSRLQAELCQKHWQDLPPSKCHSTTQNPQKETSSMWGLMVVAQLLAGIGTVPIQPFGISYVDDFSEPSNSPLYISILFAISVFGPAFGYLLGSIMLQIFVDYGRVNTAAVNLVPGDPRWIGAWWLGLLISSALLVLTSFPFFFFPRAMPIGAKRAPATADEARKLEEAKSRGSLVDFIKRFPCIFLRLLMNSLFVLVVLAQCTFSSVIAGLSTFLNKFLEKQYGTSAAYANFLIGAVNLPAAALGMLFGGILMKRFVFSLQTIPRIATTIITISMILCVPLFFMGCSTPTVAEVYPPSTSSSIHPQSPACRRDCSCPDSIFHPVCGDNGIEYLSPCHAGCSNINMSSATSKQLIYLNCSCVTGGSASAKTGSCPVPCAHFLLPAIFLISFVSLIACISHNPLYMMVLRVVNQEEKSFAIGVQFLLMRLLAWLPSPALYGLTIDHSCIRWNSLCLGRRGACAYYDNDALRDRYLGLQMGYKALGMLLLCFISWRVKKNKEYNVQKAAGLI

SEQ ID NO: 26667 - protein, 3661 aa, Homo sapiens
MSRRAPGSRLSSGGGGGGTKYPRSWNDWQPRTDSASADPDNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLEDMEAYAEDLSHVASGESVDEDVPPPSVSLPKLAALLRVFSTVVRSIGERFSPIRGPPITEAYVTDVLYRVMRCVTAANQVFFSEAVLTAANECVGVLLGSLDPSMTIHCDMVITYGLDQLENCQTCGTDYIISVLNLLTLIVEQINTKLPSSFVEKLFIPSSKLLFLRYHKEKEVVAVAHAVYQAVLSLKNIPVLETAYKLILGEMTCALNNLLHSLQLPEACSEIKHEAFKNHVFNVDNAKFVVIFDLSALTTIGNAKNSLIGMWALSPTVFALLSKNLMIVHSDLAVHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSKTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVQERNSYAVSVWKRVKAKLEGRDVDPNRRMSVAEQVDYVIKEATNLDNLAQLYEGWTAWV

SEQ ID NO: 26668 - protein, 172 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNENLSSSAVLCQLVSPNKDWRSHEESLAHTGTLRRSCM

SEQ ID NO: 26669 - protein, 867 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCFSTETFDLKTPQVTNEGEPEKELSLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQKNSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 26670 - protein, 322 aa, Homo sapiens
MLSPLPTGPLEACFSVQSRTSSPMEPPIPQSAPLTPNSVMVQPLLDSRMSHSRLQHPLTILPIDQVKTSHVENDYIDNPSLALTTGPKRTRGGAPELAPTPARCDQDVTHHWISFSGRPSSVSSSSSTSSDQRLLDHMAPPPVADQASPRAVRIQPKVVHCQPLDLKGPAVPPELDKHFLLCEACGKCKCKECASPRTLPSCWVCNQECLCSAQTLVNYGTCMCLVQGIFYHCTNEDDEGSCADHPCSCSRSNCCARWSFMGALSVVLPCLLCYLPATGCVKLAQRGYDRLRRPGCRCKHTNSVICKAASGDAKTSRPDKPF

SEQ ID NO: 26671 - protein, 318 aa, Homo sapiens
MAPWAEAEHSALNPLRAVWLTLTAAFLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKCHVILGNLRKNKAGVVIHCNHRIPFGDWFEYVSSPNYLAELMIYVSMAVTFGFHNLTWWLVVTNVFFNQALSAFLSHQFYKSKFVSYPKHRKAFLPFLF

SEQ ID NO: 26672 - protein, 261 aa, Homo sapiens
MSRYTRPPNTSLFIRNVADATRPEDLRREFGRYGPIVDVYIPLDFYTRRPRGFAYVQFEDVRGAEDALYNLNRKWVCGRQIEIQFAQGDRKTPGQMKSKERHPCSPSDHRRSRSPSQRRTRSRSSSWGRNRRRSDSLKESRHRRFSYSKSKSRSKSLPRRSTSARQSRTPRRNFGSRGRSRSKSLQKRSKSIGKSQSSSPQKQTSSGTKSRSHGRHSDSIARSPCKSPKGYTNSETKVQTAKHSHFRSHSRSRSYRHKNSW

SEQ ID NO: 26673 - protein, 2551 aa, Homo sapiens
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 26674 - protein, 750 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 26675 - protein, 712 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEV

SEQ ID NO: 26676 - protein, 414 aa, Homo sapiens
MIPLEKPGSGGSSPGATSGSGRAGRGLSGPCRPPPPPQARGLLTEIRAVVRTEPFQDGYSLCPGRELGRGKFAVVRKCIKKDSGKEFAAKFMRKRRKGQDCRMEIIHEIAVLELAQDNPWVINLHEVYETASEMILVLEYAAGGEIFDQCVADREEAFKEKDVQRLMRQILEGVHFLHTRDVVHLDLKPQNILLTSESPLGDIKIVDFGLSRILKNSEELREIMGTPEYVAPEILSYDPISMATDMWSIGVLTYVMLTGISPFLGNDKQETFLNISQMNLSYSEEEFDVLSESAVDFIRTLLVKKPEDRATAEECLKHPWLTQSSIQEPSFRMEKALEEANALQEGHSVPEINSDTDKSETEESIVTEELIVVTSYTLGQCRQSEKEKMEQKAISKRFKFEEPLLQEIPGEFIY

SEQ ID NO: 26677 - protein, 372 aa, Homo sapiens
MSRRRFDCRSISGLLTTTPQIPIKMENFNNFYILTSKELGRGKFAVVRQCISKSTGQEYAAKFLKKRRRGQDCRAEILHEIAVLELAKSCPRVINLHEVYENTSEIILILEYAAGGEIFSLCLPELAEMVSENDVIRLIKQILEGVYYLHQNNIVHLDLKPQNILLSSIYPLGDIKIVDFGMSRKIGHACELREIMGTPEYLAPEILNYDPITTATDMWNIGIIAYMLLTHTSPFVGEDNQETYLNISQVNVDYSEETFSSVSQLATDFIQSLLVKNPEKRPTAEICLSHSWLQQWDFENLFHPEETSSSSQTQDHSVRSSEDKTSKSSCNGTCGDREDKENIPEDSSMVSKRFRFDDSLPNPHELVSDLLC

SEQ ID NO: 26678 - protein, 486 aa, Homo sapiens
MRSGAERRGSSAAASPGSPPPGRARPAGSDAPSALPPPAAGQPRARDSGDVRSQPRPLFQWSKWKKRMGSSMSAATARRPVFDDKEDVNFDHFQILRAIGKGSFGKVCIVQKRDTEKMYAMKYMNKQQCIERDEVRNVFRELEILQEIEHVFLVNLWYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPICPSAGSG

SEQ ID NO: 26679 - protein, 376 aa, Homo sapiens
MSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 26680 - protein, 910 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 26681 - protein, 1272 aa, Homo sapiens
MDEPNAEQVYNPSQFENLRKFWDLEANSNSKDNDKNITTTSQKNSAPFNRQKHKEFSDIKLSGKNTHEAEVLLSPKKVMAREEMEKLNSKGILQVLPDEITFPLSPLRKYTYQLPGNESSKENVEKNTEGIVTPVFKEEKDYSEQEIQESIIKTNVLSKDCKDTFNDSLQKLLSETSTPAIQPSGGKVHGKQVLEPSVSENRTWPQKTDFADTEEEVKGPEKIINEHVDKTVVHPKVKRNSLTASLDKLLKEATGTSPSPLQAKLAPVITGTNSKLEEGRFFGKGIEQSHNTSADKREILAPFPVRDETFGNTALLKKAESGECQLSTQNLIQMAAEDSHPLDPTSQLSRKGSFGDVASPPQDMLFPQDAHLVPQARVHPSQTEISETVEKVILPPRPVLNDVSAALQKLCGEVWLSYPAGREVGPGEVNPEFPEAVQPVCSPLNPPGVISPWATMDTIVPDRKDFYSSNVVPDKTHEVGSYLAAQMSPSDQTLSSFASIVAQYGKGLPQEVEEIVRETIVQPKSEFLEFSAGLEKLLKEETETFPSKYESDTGNLSPSKLIGSTEEPRRATSECHPEELKETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 26682 - protein, 1256 aa, Homo sapiens
MDEPNAEQVYNPSQFENLRKFWDLEANSNSKDNDKNITTTSQKNSAPFNRQKHKEFSDIKLSGKNTHEAEVLLSPKKVMAREEMEKLNSKGILQVLPDEITFPLSPLRKYTYQLPGNESSKENVEKNTEGIVTPVFKEEKDYSEQEIQESIIKTNVLSKDCKDTFNDSLQKLLSETSTPAIQPSGGKVHGKQVLEPSVSENRTWPQKTDFADTEEEVKGPEKIINEHVDKTVVHPKVKRNSLTASLDKLLKEATGTSPSPLQAKLAPVITGTNSKLEEGRFFGKGIEQSHNTSADKREILAPFPVRDETFGNTALLKKAESGECQLSTQNLIQMAAEDSHPLDPTSQLSRKGSFGDVASPPQDMLFPQDAHLVPQARVHPSQTEISETVEKVILPPRPVLNDVSAALQKLCGEVWLSYPAGREVGPGEVNPEFPEAVQPVCSPLNPPGVISPWATMDTIVPDRKDFYSSNVVPDKTHEVGSYLAAQMSPSDQTLSSFASIVAQYGKGLPQEVEEIVRETIVQPKSEFLEFSAGLEKLLKEETETFPSKYESDTGNLSPSKLIGSTEEPRRATSECHPEELKETVEKAEAPLITESAFDAGFEKLLKEITEAPPYQPQVSVREETHEKESSQSEQTRFLGTVPHFYRAASQTSEMKDKSNGLESQVNQCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 26683 - protein, 376 aa, Homo sapiens; identical to SEQ ID NO: 26679

SEQ ID NO: 26684 - protein, 365 aa, Homo sapiens
MSDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 26685 - protein, 703 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQAVQRAHQILVLQEGKLQKLAQLQEGQDLYSRLVQQRLMD

SEQ ID NO: 26686 - protein, 1134 aa, Homo sapiens
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASTSTLSSAKPFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPAPVFLAPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 26687 - protein, 592 aa, Homo sapiens
MGRGLLRGLWPLHIVLWTRIASTIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 26688 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 26689 - protein, 807 aa, Homo sapiens
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFFTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 26690 - protein, 190 aa, Homo sapiens
MAVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 26691 - protein, 417 aa, Homo sapiens
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 26692 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSRARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 26693 - protein, 132 aa, Homo sapiens
MSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 26694 - protein, 234 aa, Homo sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 26695 - protein, 475 aa, Homo sapiens [sequence omitted]

SEQ ID NO: 26696 - protein, 493 aa, Homo sapiens
MASGILVNVKEEVTCPICLELLTQPLSLDCGHSFCQACLTANHKKSMLDKGESSCPVCRISYQPENIRPNRHVANLVEKLREVKLSPEGQKVDHCARHGEKLLLFCQEDGKVICWLCERSQEHRGHHTFPTEEVAQEYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWVDVTVAPNNISCAVISEDKRQVSSPKPQIIYGARGTRYQTFVNFNYCTGILGSQSITSGKHYWEVDVSKKTAWILGVCAGFQPDAMCNIEKNENYQPKYGYWVIGLEEGVKCSAFQDSSFHTPSVPFIVPLSVIICPDRVGVFLDYEACTVSFFNITNHGFLIYKFSHCSFSQPVFPYLNPRKCGVPMTLCSPSS

SEQ ID NO: 26697 - protein, 347 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAQEYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWGKEKSHYHKPPCGLSLLLSLSFRILCSLLGSCFKIYDSPSKTHITYPSL

SEQ ID NO: 26698 - protein, 326 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAQEYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWGWSAMARSRFTATSTSQIQAILLPQPPK

SEQ ID NO: 26699 - protein, 581 aa, Homo sapiens
MAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSRLDETIQAIANGTLNQPLTKLDRSSEEPLGVLVNPNMYQSPPQWVDHTGAASQKKAFRSSGFGLEFNSFQHQLRIQDQEFQEGFDGGWCLSVHQPWASLLVRGIKRVEGRSWYTPHRGRLWIAATAKKPSPQEVSELQATYRLLRGKDVEFPNDYPSGCLLGCVDLIDCLSQKQFKEQFPDISQESDSPFVFICKNPQEMVVKFPIKGNPKIWKLDSKIHQGAKKGLMKQNKAV

SEQ ID NO: 26700 - protein, 467 aa, Homo sapiens
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 26701 - protein, 1141 aa, Homo sapiens
MAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 26702 - protein, 1281 aa, Homo sapiens
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTDPAHTKI

SEQ ID NO: 26703 - protein, 307 aa, Homo sapiens
MTAGSPEECGEVRRSPEGRVSRLGRRLGRRRRPRSPPEPLRVRARLRLRSPSGAFAALGALVVLVGMGIAVAGYWPHRAGAPGSRAANASSPQMSELRREGRGGGRAHGPHERLRLLGPVIMGVGLFVFICANTLLYENRDLETRRLRQGVLRAQALRPPDGPGWDCALLPSPGPRSPRAVGCAEPEIWDPSPRRGTSPVPSVRSLRSEPANPRLGLPALLNSYPLKGPGLPPPWGPRTQTGHVIITVQPSGSCIEHSKSLDLGLGELLLGAPAARDCAHRSWPRLDRLSLGGYAKLGGGGDLGARV

SEQ ID NO: 26704 - protein, 449 aa, Homo sapiens
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLTVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAVAEAWARLDHKFDLMYAKRAFVHWYVGEGMEEGEFSEAREDMAALEKDYEEVGADSADGEDEGEEY

SEQ ID NO: 26705 - protein, 1516 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSTPVYDAIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATTIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINLKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 26706 - protein, 384 aa, Homo sapiens
MAGAEWKSLEECLEKHLPLPDLQEVKRVLYGKELRKLDLPREAFEAASREDFELQGYAFEAAEEQLRRPRIVHVGLVQNRIPLPANAPVAEQVSALHRRIKAIVEVAAMCGVNIICFQEAWTMPFAFCTREKLPWTEFAESAEDGPTTRFCQKLAKNHDMVVVSPILERDSEHGDVLWNTAVVISNSGAVLGKTRKNHIPRVGDFNESTYYMEGNLGHPVFQTQFGRIAVNICYGRHHPLNWLMYSINGAEIIFNPSATIGALSESLWPIEARNAAIANHCFTCAINRVGTEHFPNEFTSGDGKKAHQDFGYFYGSSYVAAPDSSRTPGLSRSRDGLLVAKLDLNLCQQVNDVWNFKMTGRYEMYARELAEAVKSNYSPTIVKE

SEQ ID NO: 26707 - protein, 1042 aa, Homo sapiens
MDKILEGLVSSSHPLPLKRVIVRKVVESAEHWLDEAQCEAMFDLTTRLILEGQDPFQRQVGHQVLEAYARYHRPEFESFFNKTFVLGLLHQGYHSLDRKDVAILDYIHNGLKLIMSCPSVLDLFSLLQVEVLRMVCERPEPQLCARLSDLLTDFVQCIPKGKLSITFCQQLVRTIGHFQCVSTQERELREYVSQVTKVSNLLQNIWKAEPATLLPSLQEVFASISSTDASFEPSVALASLVQHIPLQMITVLIRSLTTDPNVKDASMTQALCRMIDWLSWPLAQHVDTWVIALLKGLAAVQKFTILIDVTLLKIELVFNRLWFPLVRPGALAVLSHMLLSFQHSPEAFHLIVPHVVNLVHSFKNDGLPSSTAFLVQLTELIHCMMYHYSGFPDLYEPILEAIKDFPKPSEEKIKLILNQSAWTSQSNSLASCLSRLSGKSETGKTGLINLGNTCYMNSVIQALFMATDFRRQVLSLNLNGCNSLMKKLQHLFAFLAHTQREAYAPRIFFEASRPPWFTPRSQQDCSEYLRFLLDRLHEEEKILKVQASHKPSEILECSETSLQEVASKAAVLTETPRTSDGEKTLIEKMFGGKLRTHIRCLNCRSTSQKVEAFTDLSLAFCPSSSLENMSVQDPASSPSIQDGGLMQASVPGPSEEPVVYNPTTAAFICDSLVNEKTIGSPPNEFYCSENTSVPNESNKILVNKDVPQKPGGETTPSVTDLLNYFLAPEILTGDNQYYCENCASLQNAEKTMQITEEPEYLILTLLRFSYDQKYHVRRKILDNVSLPLVLELPVKRITSFSSLSESWSVDVDFTDLSENLAKKLKPSGTDEASCTKLVPYLLSSVVVHSGISSESGHYYSYARNITSTDSSYQMYHQSEALALASSQSHLLGRDSPSAVFEQDLENKEMSKEWFLFNDSRVTFTSFQSVQKITSRFPKDTAYVLLYKKQHSTNGLSGNNPTSGLWINGDPPLQKELMDAITKDNKLYLQEQELNARARALQAASASCSFRPNGFDDNDPPGSCGPTGGGGGGGFNTVGRLVF

SEQ ID NO: 26708 - protein, 182 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTRPGPILIHLFSINCLGAHSESVC

SEQ ID NO: 26709 - protein, 289 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKWVHLHLI

SEQ ID NO: 26710 - protein, 347 aa, Homo sapiens [sequence omitted]

SEQ ID NO: 26711 - protein, 379 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKAPRFKDFQQQDSQELLHYLLDAVRTEETKISTVKDPFIDISLPIIEERVSKPLLWGRMNKYRSLRETDHDRYSGNVTIENIHQPRAAKKHSSSKDKR

SEQ ID NO: 26712 - protein, 289 aa, Homo sapiens; identical to SEQ ID NO: 26709

SEQ ID NO: 26713 - protein, 107 aa, Homo sapiens
MLDLAPFCSATCKNASVGDKVLYGLYGIVEHSGSMREGHYTAYVKVRTPSRKLSEHNTKKKNVPGLKAADNESAGQWVHVSDTYLQVVPESRALSAQAYLLFYERVL

SEQ ID NO: 26714 - protein, 494 aa, Homo sapiens
MRSKKVVQNSRFFLPQTLSWAPRFKDFQQQDSQELLHYLLDAVRTEETKISTVKDPFIDISLPIIEERVSKPLLWGRMNKYRSLRETDHDRYSGNVTIENIHQPRAAKKHSSSKDKSQLIHDRKCIRKLSSGETVTYQKNENLEMNGDSLMFASLMNSESRLNESPTDDSEKEASHSESNVDADSEPSESESASKQTGLFRSSSGSGVQPDGPLYPLSAGKLLYTKETDSGDKEMAEAISELRLSSTVTGDQDFDRENQPLNISNNLCFLEGKHLRSYSPQNAFQTLSQSYITTSKECSIQSCLYQFTSMELLMGNNKLLCENCTKNKQKYQEETSFAEKKVEGVYTNARKQLLISAVPAVLILHLKRFHQAGLSLRKVNRHVDFPLMLDLAPFCSATCKNASVGDKVLYGLYGIVEHSGSMREGHYTAYVKVRTPSRKLSEHNTKKKNVPGLKAADNESAGQWVHVSDTYLQVVPESRALSAQAYLLFYERVL

SEQ ID NO: 26715 - protein, 182 aa, Homo sapiens; identical to SEQ ID NO: 26708

SEQ ID NO: 26716 - protein, 289 aa, Homo sapiens; identical to SEQ ID NO: 26709

SEQ ID NO: 26717 - protein, 347 aa, Homo sapiens [sequence omitted]

SEQ ID NO: 26718 - protein, 379 aa, Homo sapiens; identical to SEQ ID NO: 26711

SEQ ID NO: 26719 - protein, 289 aa, Homo sapiens; identical to SEQ ID NO: 26709

SEQ ID NO: 26720 - protein, 107 aa, Homo sapiens
MLDLAPFCSATCKNASVGDKVLYGLYGIVEHSGSMREGHYTAYVKVRTPSRKLSEHNTKKKNVPGLKAADSESAGQWVHVSDTYLQVVPESRALSAQAYLLFYERVL

SEQ ID NO: 26721 - protein, 494 aa, Homo sapiens [sequence omitted]

SEQ ID NO: 26722 - protein, 420 aa, Homo sapiens
MVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 26723 - protein, 100 aa, Homo sapiens
MSTGPTAATGSNRRLQQTQNQVDEVVDIMRVNVDKVLERDQKLSELDDRADALQAGASQFETSAAKLKRKYWWKNCKMWAIGITVLVIFIIIIIVWVVSS

SEQ ID NO: 26724 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 26725 - protein, 647 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQAFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 26726 - protein, 294 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 26727 - protein, 503 aa, Homo sapiens
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 26728 - protein, 476 aa, Homo sapiens
MVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCLHSEKAHDLGITCCDFSSQPVSDGEQGLQFFRLASCGQDCQVKIWIVSFTHILGFELKYKSTLSGHCAPVLACAFSHDGQMLVSGSVDKSVIVYDTNTENILHTLTQHTRYVTTCAFAPNTLLLATGSMDKTVNIWQFDLETLCQARSTEHQLKQFTEDWSEEDVSTWLCAQDLKDLVGIFKMNNIDGKELLNLTKESLADDLKIESLGLRSKVLRKIEELRTKVKSLSSGIPDEFICPITRELMKDPVIASDGYSYEKEAMENWISKKKRTSPMTNLVLPSAVLTPNRTLKMAINRWLETHQK

SEQ ID NO: 26729 - protein, 322 aa, Homo sapiens
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 26730 - protein, 201 aa, Homo sapiens
MQPEASSLSQNRDASGPRRGCWLWERREQPSVTERVPTALGVPRMCVAQVLTAHLLPPRQALGSLCSPWAAPRVGPLPPAPAMVRISKPKTFQAYLDDCHRRYSCAHCRAHLANHDDLISKSFQGSQGRAYLFNSVVNVGCGPAEERVLLTGLHAVADIHCENCKTTLGWKYEQAFESSQKYKEGKYIIELNHMIKDNGWD

SEQ ID NO: 26731 - protein, 247 aa, Homo sapiens
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 26732 - protein, 455 aa, Homo sapiens
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLLPLAARMSEESYFESKTEESNSAEMSCQITATSNGEGHGMNPSLQAMMLMGFGDIFSMNKAGAVMHSGMQINMQAKQNSSKTTSKRRGKKVNMALGFSDFDLSEGDDDDDDDGEEEDNDMDNSE

SEQ ID NO: 26733 - protein, 492 aa, Homo sapiens
MVILLLQHGADPTLIDGEGFSSIHLAVLFQHMPIIAYLISKGQSVNMTDVNGQTPLMLSAHKVIGPEPTGFLLKFNPSLNVVDKIHQNTPLHWAVAAGNVNAVDKLLEAGSSLDIQNVKGETPLDMALQNKNQLIIHMLKTEAKMRANQKFRLWRWLQKCELFLLLMLSVITMWAIGYILDFNSDSWLLKGCLLVTLFFLTSLFPRFLVGYKNLVYLPTAFLLSSVFWIFMTWFILFFPDLAGAPFYFSFIFSIVAFLYFFYKTWATDPGFTKASEEEKKVNIITLAETGSLDFRTFCTSCLIRKPLRSLHCHVCNCCVARYDQHCLWTGRCIGFGNHHYYIFFLFFLSMVCGWIIYGSFIYLSSHCATTFKEDGLWTYLNQIVACSPWVLYILMLATFHFSWSTFLLLNQLFQIAFLGLTSHERISLQKQSKHMKQTLSLRKTPYNLGFMQNLADFFQCGCFGLVKPCVVDWTSQYTMVFHPAREKVLRSV

SEQ ID NO: 26734 - protein, 622 aa, Homo sapiens
MEGPGLGSQCRNHSHGPHPPGFGRYGICAHENKELANAREALPLIEDSSNCDIVKATQYGIFERCKELVEAGYDVRQPDKENVSLLHWAAINNRLDLVKFYISKGAVVDQLGGDLNSTPLHWAIRQGHLPMVILLLQHGADPTLIDGEGFSSIHLAVLFQHMPIIAYLISKGQSVNMTDVNGQTPLMLSAHKVIGPEPTGFLLKFNPSLNVVDKIHQNTPLHWAVAAGNVNAVDKLLEAGSSLDIQNVKGETPLDMALQNKNQLIIHMLKTEAKMRANQKFRLWRWLQKCELFLLLMLSVITMWAIGYILDFNSDSWLLKGCLLVTLFFLTSLFPRFLVGYKNLVYLPTAFLLSSVFWIFMTWFILFFPDLAGAPFYFSFIFSIVAFLYFFYKTWATDPGFTKASEEEKKVNIITLAETGSLDFRTFCTSCLIRKPLRSLHCHVCNCCVARYDQHCLWTGRCIGFGNHHYYIFFLFFLSMVCGWIIYGSFIYLSSHCATTFKEDGLWTYLNQIVACSPWVLYILMLATFHFSWSTFLLLNQLFQIAFLGLTSHERISLQKQSKHMKQTLSLRKTPYNLGFMQNLADFFQCGCFGLVKPCVVDWTSQYTMVFHPAREKVLRSV

SEQ ID NO: 26735 - protein, 284 aa, Homo sapiens
MGQPWAAGSTDGAPAQLPLVLTALWAAAVGLELAYVLVLGPGPPPLGPLARALQLALAAFQLLNLLGNVGLFLRSDPSIRGVMLAGRGLGQGWAYCYQCQSQVPPRSGHCSACRVCILRRDHHCRLLGRCVGFGNYRPFLCLLLHAAGVLLHVSVLLGPALSALLRAHTPLHMAALLLLPWLMLLTGRVSLAQFALAFVTDTCVAGALLCGAGLLFHGMLLLRGQTTWEWARGQHSYDLGPCHNLQAALGPRWALVWLWPFLASPLPGDGITFQTTADVGHTAS

SEQ ID NO: 26736 - protein, 338 aa, Homo sapiens
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDQEGYLSSSSSSHSGSDSPTLDNSRRLPIFSRLSISDD

SEQ ID NO: 26737 - protein, 570 aa, Homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERVSLMADGKIFVGSGSSGGTEGLVMNSDILGATTEVLIEDSDSAGP

SEQ ID NO: 26738 - protein, 529 aa, Homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERSIHR

SEQ ID NO: 26739 - protein, 1151 aa, Homo sapiens
MSRRKQSKPRQIKRPLEDAIEDEEEECPSEETDIISKGDFPLEESFSTEFGPENLSCEEVEYFCNKGDDEGIQETAESDGDTQSEKPGQPGVETDDWDGPGELEVFQKDGERKIQSRQQLPVGTTWGPFPGKMDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNKDIFPCKSCGIWYRSERNLQAHLMYYCSGRQREAAPVSEENEDSAHQISSLCPFPQCTKSFSNARALEMHLNSHSGVKMEEFLPPGASLKCTVCSYTADSVINFHQHLFSHLTQAAFRCNHCHFGFQTQRELLQHQELHVPSGKLPRESDMEHSPSATEDSLQPATDLLTRSELPQSQKAMQTKDASSDTELDKCEKKTQLFLTNQRPEIQPTTNKQSFSYTKIKSEPSSPRLASSPVQPNIGPSFPVGPFLSQFSFPQDITMVPQASEILAKMSELVHRRLRHGSSSYPPVIYSPLMPKGATCFECNITFNNLDNYLVHKKHYCSSRWQQMAKSPEFPSVSEKMPEALSPNTGQTSINLLNPAAHSADPENPLLQTSCINSSTVLDLIGPNGKGHDKDFSTQTKKLSTSSNNDDKINGKPVDVKNPSVPLVDGESDPNKTTCEACNITFSRHETYMVHKQYYCATRHDPPLKRSASNKVPAMQRTMRTRKRRKMYEMCLPEQEQRPPLVQQRFLDVANLNNPCTSTQEPTEGLGECYHPRCDIFPGIVSKHLETSLTINKCVPVSKCDTTHSSVSCLEMDVPIDLSKKCLSQSERTTTSPKRLLDYHECTVCKISFNKVENYLAHKQNFCPVTAHQRNDLGQLDGKVFPNPESERNSPDVSYERSIIKCEKNGNLKQPSPNGNLFSSHLATPQGLKVFSEAAQLIATKEENRHLFLPQCLYPGAIKKAKGADQLSPYYGIKPSDYISGSLVIHNTDIEQSRNAENESPKGQASSNGCAALKKDSLPLLPKNRGMVIVNGGLKQDERPAANPQQENISQNPQHEDDHKSPSWISENPLAANENVSPGIPSAEEQLSSIAKGVNGSSQAPTSGKYCRLCDIQFNNLSNFITHKKFYCSSHAAEHVK

SEQ ID NO: 26740 - protein, 563 aa, Homo sapiens
MMTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 26741 - protein, 590 aa, Homo sapiens
MAFRDVAVAFTQKEWKLLSSAQRTLYREVMLENYSHLVSLGIAFSKPKLIEQLEQGDEPWREENEHLLDLCPEPRTEFQPSFPHLVAFSSSQLLRQYALSGHPTQIFPSSSAGGDFQLEAPRCSSEKGESGETEGPDSSLRKRPSRISRTFFSPHQGDPVEWVEGNREGGTDLRLAQRMSLGGSDTMLKGADTSESGAVIRGNYRLGLSKKSSLFSHQKHHVCPECGRGFCQRSDLIKHQRTHTGEKPYLCPECGRRFSQKASLSIHQRKHSGEKPYVCRECGRHFRYTSSLTNHKRIHSGERPFVCQECGRGFRQKIALLLHQRTHLEEKPFVCPECGRGFCQKASLLQHQSSHTGERPFLCLECGRSFRQQSLLLSHQVTHSGEKPYVCAECGHSFRQKVTLIRHQRTHTGEKPYLCPQCGRGFSQKVTLIGHQRTHTGEKPYLCPDCGRGFGQKVTLIRHQRTHTGEKPYLCPKCGRAFGFKSLLTRHQRTHSEEELYVDRVCGQGLGQKSHLISDQRTHSGEKPCICDECGRGFGFKSALIRHQRTHSGEKPYVCRECGRGFSQKSHLHRHRRTKSGHQLLPQEVF

SEQ ID NO: 26742 - protein, 626 aa, Homo sapiens
MVERACEIKDNSQCGGPFTQTQDSIVNEKIPGVDPWESSECTDVLMGRSSLNCYIRVDSEHKPYEYQEYGEKPYTHTQCGTAFSYQPCFQIHERPQHGKKLYDCKECASFSSLENLQRHMAAHHGDGPRICKLCGNAFIWPSLFHMLRRTHTEEKPYEYEQCSTAFPAYSSTLRHERTHSGEKPYQCKQCGKAFSCSCYTQLYERTHTGEQSYECKQCGKAFYHLGSFQRHMIVHTGDGPHKCKICGKGFLSPSSVRRHKRTHTGEKPYECKYCGKAFSDCTGFRRHMITHTGDGPHKCKVCGKAFDSPSLCRRHETAHTGEKPYKCECGKAFSDFYYFRNHETTHTGEKPYKCKQCGKAFICCTYLQIHERIHTGERPYKCKQCGKAFRSSNYIRVHEKTHTGEKPYECKQCGKALSHLKSFQRHMIMHTGDGPHKCKICGKSFDSPSSFRRHERIHTGERPYKCKLCGKGFRSSSYIQLHERTHTGEKPYGCQQCGKALSDLSSFRRHMITHTGNGPHKCKICGKGFDYPSSVQRHERTHTGEKPYECKECGKAFSHSSYLRIHERVHTGEKPYKCKECGKPFHCPSAFHKHERTHSMEKPYKCKECGEAFHCISSFHKHEMTH

SEQ ID NO: 26743 - protein, 1061 aa, Homo sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 26744 - protein, 1013 aa, Homo sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 26745 - protein, 1978 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAAKTGQAKASVAKVNKSTGKSASSVKSVVTVAVKGNKASIKTAKSGGKKSLEAKKTGNVKNKDSNKPVTIPENSEIKTSIEVKATENCAKEAISDAALEATENEPLNKETEEMCVMLVSNLPNKGYSVEEVYDLAKPFGGLKDILILSSHKKAYIEINRKAAESMVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPELEKESPGLKNSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 26746 - protein, 1978 aa, Homo sapiens; identical to SEQ ID NO: 26745

SEQ ID NO: 26747 - protein, 299 aa, Homo sapiens
MQKHLKNHVKKIQRQQIAAAQQDDQEVTALEEINCSSSSISFENGNSDSKDLEVETLTASSEGNKEVIPEHVAEFIEIPISVPEDVIENVIENGSPNNSLNNVFKPLTECGDDYEEEEDEEGDYEEDDYDLNQETSVIHKINGTVCHPKDIYATDQEGNFKCPALGCVRIFKRIGFLNKHAMTVHPTDLNVRQTVMKWSKGKCKFCQRQFEDSQHFIDQLNRHSYPNVYFCLHFNCNESFKLPFQLAQHTKSHRTFQAQCSFPECHELFEDLPLLYEHEAQHYLSKTPESSAQPSETIL

SEQ ID NO: 26748 - protein, 851 aa, Homo sapiens
MAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVSVRVAAPPNDGQEETASCPVQGTSEAEAQKQAEEADEATEEDSDDDEEDTEIPPGAVITRAPVLFQSPRGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 26749 - DNA, 17 bp, Homo sapiens
gatctagtccaaacata

SEQ ID NO: 26750 - DNA, 17 bp, Homo sapiens
gatctgaaatgttcttg

SEQ ID NO: 26751 - DNA, 17 bp, Homo sapiens
gatctctagtacagcaa

SEQ ID NO: 26752 - DNA, 17 bp, Homo sapiens
gatccttaaacagcaaa

SEQ ID NO: 26753 - DNA, 17 bp, Homo sapiens
gatcaccgtactcgccg

SEQ ID NO: 26754 - DNA, 17 bp, Homo sapiens
gatcaataaagacaaga

SEQ ID NO: 26755 - DNA, 17 bp, Homo sapiens
gatccatctcaaaataa

SEQ ID NO: 26756 - DNA, 17 bp, Homo sapiens
gatcattgatgtcttaa

SEQ ID NO: 26757 - DNA, 17 bp, Homo sapiens
gatctgtagaacctttc

SEQ ID NO: 26758 - DNA, 17 bp, Homo sapiens
gatcataattggcctat

SEQ ID NO: 26759 - DNA, 17 bp, Homo sapiens
gatctaaaatgacattt

SEQ ID NO: 26760 - DNA, 17 bp, Homo sapiens
gatcaggagcgatagag

SEQ ID NO: 26761 - DNA, 17 bp, Homo sapiens
gatcttaaaacaccgct

SEQ ID NO: 26762 - DNA, 17 bp, Homo sapiens
gatcagaagacttacgg

SEQ ID NO: 26763 - DNA, 17 bp, Homo sapiens
gatctgctttgtccagc

SEQ ID NO: 26764 - DNA, 17 bp, Homo sapiens
gatcgtatcactgccct

SEQ ID NO: 26765 - DNA, 17 bp, Homo sapiens
gatcctggacaagttat

SEQ ID NO: 26766 - DNA, 17 bp, Homo sapiens
gatctcaaataagcaac

SEQ ID NO: 26767 - DNA, 17 bp, Homo sapiens
gatcttggacaagttgg

SEQ ID NO: 26768 - DNA, 17 bp, Homo sapiens
gatcacataagaaacgc

SEQ ID NO: 26769 - DNA, 17 bp, Homo sapiens
gatctcaacattctcat

SEQ ID NO: 26770 - DNA, 17 bp, Homo sapiens
gatctgtaacctgacta

SEQ ID NO: 26771 - DNA, 17 bp, Homo sapiens
gatctgttgaatttggg

SEQ ID NO: 26772 - DNA, 17 bp, Homo sapiens
gatcacttgagcccgaa

SEQ ID NO: 26773 - DNA, 17 bp, Homo sapiens
gatcacaaaaaaagtca

SEQ ID NO: 26774 - DNA, 17 bp, Homo sapiens
gatcagcctccgcaaca

SEQ ID NO: 26775 - DNA, 17 bp, Homo sapiens
gatccacccctttcccc

SEQ ID NO: 26776 - DNA, 17 bp, Homo sapiens
gatccaagcctcctatc

SEQ ID NO: 26777 - DNA, 17 bp, Homo sapiens
gatccaagtctccacac

SEQ ID NO: 26778 - DNA, 17 bp, Homo sapiens
gatcctctcactttagc

SEQ ID NO: 26779 - DNA, 17 bp, Homo sapiens
gatccagcggtcatccc

SEQ ID NO: 26780 - DNA, 17 bp, Homo sapiens
gatcttggccttctcag

SEQ ID NO: 26781 - DNA, 17 bp, Homo sapiens
gatctacagatgtacaa

SEQ ID NO: 26782 - DNA, 17 bp, Homo sapiens
gatctggggtttccctt

SEQ ID NO: 26783 - DNA, 17 bp, Homo sapiens
gatccgccatctgctga

SEQ ID NO: 26784 - DNA, 17 bp, Homo sapiens
gatcagttcccggatgt

SEQ ID NO: 26785 - DNA, 17 bp, Homo sapiens
gatccgccaggagttcg

SEQ ID NO: 26786 - DNA, 17 bp, Homo sapiens
gatcttctgtataattc

SEQ ID NO: 26787 - DNA, 17 bp, Homo sapiens
gatcacatcgttggggt

SEQ ID NO: 26788 - DNA, 17 bp, Homo sapiens
gatcattaaagaaggtt

SEQ ID NO: 26789 - DNA, 17 bp, Homo sapiens
gatctgaactcttcact

SEQ ID NO: 26790 - DNA, 17 bp, Homo sapiens
gatctggcaaaggtgtt

SEQ ID NO: 26791 - DNA, 17 bp, Homo sapiens
gatcttagcaaacagac

SEQ ID NO: 26792 - DNA, 17 bp, Homo sapiens
gatcaagggagggtttt

SEQ ID NO: 26793 - DNA, 17 bp, Homo sapiens
gatctcacattttgcga

SEQ ID NO: 26794 - DNA, 17 bp, Homo sapiens
gatctctgcagctacct

SEQ ID NO: 26795 - DNA, 17 bp, Homo sapiens
gatccactatgtccagc

SEQ ID NO: 26796 - DNA, 17 bp, Homo sapiens
gatccttccctcagtga

SEQ ID NO: 26797 - DNA, 17 bp, Homo sapiens
gatcatcataaaagtct

SEQ ID NO: 26798 - DNA, 17 bp, Homo sapiens
gatctagccagtgcaat

SEQ ID NO: 26799 - DNA, 17 bp, Homo sapiens
gatccagtacaagtgat

SEQ ID NO: 26800 - DNA, 17 bp, Homo sapiens
gatcaggtggggagtca

SEQ ID NO: 26801 - DNA, 17 bp, Homo sapiens
gatcagcaatgtctggt

SEQ ID NO: 26802 - DNA, 17 bp, Homo sapiens
gatcttatttgaaaaat

SEQ ID NO: 26803 - DNA, 17 bp, Homo sapiens
gatcttgttcaaccttg

SEQ ID NO: 26804 - DNA, 17 bp, Homo sapiens
gatcacttaactacttt

SEQ ID NO: 26805 - DNA, 17 bp, Homo sapiens
gatcagcatgttgacat

SEQ ID NO: 26806 - DNA, 17 bp, Homo sapiens
gatcagcgtcttcaccc

SEQ ID NO: 26807 - DNA, 17 bp, Homo sapiens
gatctttgtgggaactc

SEQ ID NO: 26808 - DNA, 17 bp, Homo sapiens
gatccatttcacaattt

SEQ ID NO: 26809 - DNA, 17 bp, Homo sapiens
gatcaatttttgacagt

SEQ ID NO: 26810 - DNA, 17 bp, Homo sapiens
gatcatcatcaccggga

SEQ ID NO: 26811 - DNA, 17 bp, Homo sapiens
gatctaactgaaagaga

SEQ ID NO: 26812 - DNA, 17 bp, Homo sapiens
gatcaccagtttgtgca

SEQ ID NO: 26813 - DNA, 17 bp, Homo sapiens
gatccgcctcagagttt

SEQ ID NO: 26814 - DNA, 17 bp, Homo sapiens
gatcccagtgttcccaa

SEQ ID NO: 26815 - DNA, 17 bp, Homo sapiens
gatcaccaacatgaaca

SEQ ID NO: 26816 - DNA, 17 bp, Homo sapiens
gatcttcatcatcatac

SEQ ID NO: 26817 - DNA, 17 bp, Homo sapiens
gatcccaggaagctttg

SEQ ID NO: 26818 - DNA, 17 bp, Homo sapiens
gatctgaaaggtaaaca

SEQ ID NO: 26819 - DNA, 17 bp, Homo sapiens
gatctggttttagccca

SEQ ID NO: 26820 - DNA, 17 bp, Homo sapiens
gatcgagcccaccattt

SEQ ID NO: 26821 - DNA, 17 bp, Homo sapiens
gatcccacccccgcagc

SEQ ID NO: 26822 - DNA, 17 bp, Homo sapiens
gatcatcttaattatca

SEQ ID NO: 26823 - DNA, 17 bp, Homo sapiens
gatcttacagacagtga

SEQ ID NO: 26824 - DNA, 17 bp, Homo sapiens
gatccttttgagttatg

SEQ ID NO: 26825 - DNA, 17 bp, Homo sapiens
gatcaaggtagtatact

SEQ ID NO: 26826 - DNA, 17 bp, Homo sapiens
gatctaccatgcaaaag

SEQ ID NO: 26827 - DNA, 17 bp, Homo sapiens
gatcttatttctagaaa

SEQ ID NO: 26828 - DNA, 17 bp, Homo sapiens
gatccacacaaatcaat

SEQ ID NO: 26829 - DNA, 17 bp, Homo sapiens
gatcttccactccctgg

SEQ ID NO: 26830 - DNA, 17 bp, Homo sapiens
gatcattgaccattttg

SEQ ID NO: 26831 - DNA, 17 bp, Homo sapiens
gatcctcattctaagtt

SEQ ID NO: 26832 - DNA, 17 bp, Homo sapiens
gatctcagccctctgaa

SEQ ID NO: 26833 - DNA, 17 bp, Homo sapiens
gatcacggctcgctgca

SEQ ID NO: 26834 - DNA, 17 bp, Homo sapiens
gatccaatttcagtctt

SEQ ID NO: 26835 - DNA, 17 bp, Homo sapiens
gatcatgtattggtagg

SEQ ID NO: 26836 - DNA, 17 bp, Homo sapiens
gatcacccccctgctta

SEQ ID NO: 26837 - DNA, 17 bp, Homo sapiens
gatctatccaataaagg

SEQ ID NO: 26838 - DNA, 17 bp, Homo sapiens
gatcttcactgtccagt

SEQ ID NO: 26839 - DNA, 17 bp, Homo sapiens
gatcagaaccttgcaac

SEQ ID NO: 26840 - DNA, 17 bp, Homo sapiens
gatccctttagaaattt

SEQ ID NO: 26841 - DNA, 17 bp, Homo sapiens
gatcaacttggaggtta

SEQ ID NO: 26842 - DNA, 17 bp, Homo sapiens
gatcttgagctcctggc

SEQ ID NO: 26843 - DNA, 17 bp, Homo sapiens
gatctgtaatgtatttt

SEQ ID NO: 26844 - DNA, 17 bp, Homo sapiens
gatcagggagggctaaa

SEQ ID NO: 26845 - DNA, 17 bp, Homo sapiens
gatccctttgacttgag

SEQ ID NO: 26846 - DNA, 17 bp, Homo sapiens
gatcttcttggccagat

SEQ ID NO: 26847 - DNA, 17 bp, Homo sapiens
gatctgtcagggccact

SEQ ID NO: 26848 - DNA, 17 bp, Homo sapiens
gatccaacatgagctgt

SEQ ID NO: 26849 - DNA, 17 bp, Homo sapiens
gatccagagagtcatca

SEQ ID NO: 26850 - DNA, 17 bp, Homo sapiens
gatctcccaaatgagaa

SEQ ID NO: 26851 - DNA, 17 bp, Homo sapiens
gatccgatattgtctgc

SEQ ID NO: 26852 - DNA, 17 bp, Homo sapiens
gatctctgtaatgagtg

SEQ ID NO: 26853 - DNA, 17 bp, Homo sapiens
gatcttttaacaagaga

SEQ ID NO: 26854 - DNA, 17 bp, Homo sapiens
gatctaaaagccaaaaa

SEQ ID NO: 26855 - DNA, 17 bp, Homo sapiens
gatcaccgctgtgggca

SEQ ID NO: 26856 - DNA, 17 bp, Homo sapiens
gatcatggtcagagtgg

SEQ ID NO: 26857 - DNA, 17 bp, Homo sapiens
gatcctcctgttttggc

SEQ ID NO: 26858 - DNA, 17 bp, Homo sapiens
gatccatcctcactttt

SEQ ID NO: 26859 - DNA, 17 bp, Homo sapiens
gatcatatgactattgg

SEQ ID NO: 26860 - DNA, 17 bp, Homo sapiens
gatctcctcctcacctt

SEQ ID NO: 26861 - DNA, 17 bp, Homo sapiens
gatccctgtagcaggta

SEQ ID NO: 26862 - DNA, 17 bp, Homo sapiens
gatcgcctgagacacaa

SEQ ID NO: 26863 - DNA, 17 bp, Homo sapiens
gatcccaaggaagaata

SEQ ID NO: 26864 - DNA, 17 bp, Homo sapiens
gatccagcaattccaca

SEQ ID NO: 26865 - DNA, 17 bp, Homo sapiens
gatccccaaagtggtgg

SEQ ID NO: 26866 - DNA, 17 bp, Homo sapiens
gatctgatatcagaaaa

SEQ ID NO: 26867 - DNA, 17 bp, Homo sapiens
gatcacttcctatatgc

SEQ ID NO: 26868 - DNA, 17 bp, Homo sapiens
gatccagattatttttc

SEQ ID NO: 26869 - DNA, 17 bp, Homo sapiens
gatcacaacatcagaag

SEQ ID NO: 26870 - DNA, 17 bp, Homo sapiens
gatctccagaaataaat

SEQ ID NO: 26871 - DNA, 17 bp, Homo sapiens
gatccaactgaagtttt

SEQ ID NO: 26872 - DNA, 17 bp, Homo sapiens
gatctgtttcttcacta

SEQ ID NO: 26873 - DNA, 17 bp, Homo sapiens
gatcgagacccagcaaa

SEQ ID NO: 26874 - DNA, 17 bp, Homo sapiens
gatcgcctcagcctccc

SEQ ID NO: 26875 - DNA, 17 bp, Homo sapiens
gatctatctgcatctct

SEQ ID NO: 26876 - DNA, 17 bp, Homo sapiens
gatccccagacttcata

SEQ ID NO: 26877 - DNA, 17 bp, Homo sapiens
gatcttcgaatgctatt

SEQ ID NO: 26878 - DNA, 17 bp, Homo sapiens
gatccctggacccagta

SEQ ID NO: 26879 - DNA, 17 bp, Homo sapiens
gatcttttaaaggtttt

SEQ ID NO: 26880 - DNA, 17 bp, Homo sapiens
gatccaattctgcctgc

SEQ ID NO: 26881 - DNA, 17 bp, Homo sapiens
gatccagctggctcacc

SEQ ID NO: 26882 - DNA, 17 bp, Homo sapiens
gatcagtctggagcaac

SEQ ID NO: 26883 - DNA, 17 bp, Homo sapiens
gatcacttcaggtggct

SEQ ID NO: 26884 - DNA, 17 bp, Homo sapiens
gatccactactaaaaat

SEQ ID NO: 26885 - DNA, 17 bp, Homo sapiens
gatccctctcaacaatc

SEQ ID NO: 26886 - DNA, 17 bp, Homo sapiens
gatcacaagcatatctg

SEQ ID NO: 26887 - DNA, 17 bp, Homo sapiens
gatcctgcaaattctgt

SEQ ID NO: 26888 - DNA, 17 bp, Homo sapiens
gatcgagctggtcttgg

SEQ ID NO: 26889 - DNA, 17 bp, Homo sapiens
gatccttaaagtgaaaa

SEQ ID NO: 26890 - DNA, 17 bp, Homo sapiens
gatcacttctttaatag

SEQ ID NO: 26891 - DNA, 17 bp, Homo sapiens
gatcctcttgcctccgc

SEQ ID NO: 26892 - DNA, 17 bp, Homo sapiens
gatctttttcacatgca

SEQ ID NO: 26893 - DNA, 17 bp, Homo sapiens
gatcatggagaggtcag

SEQ ID NO: 26894 - DNA, 17 bp, Homo sapiens
gatcctcatacctgcta

SEQ ID NO: 26895 - DNA, 17 bp, Homo sapiens
gatctatcagggagata

SEQ ID NO: 26896 - DNA, 17 bp, Homo sapiens
gatcccagatgtgcagc

SEQ ID NO: 26897 - DNA, 17 bp, Homo sapiens
gatcatcttttcccttc

SEQ ID NO: 26898 - DNA, 17 bp, Homo sapiens
gatccctgtcaacagga

SEQ ID NO: 26899 - DNA, 17 bp, Homo sapiens
gatcatcaccagcaaag

SEQ ID NO: 26900 - DNA, 17 bp, Homo sapiens
gatcttgtgaaaggaag

SEQ ID NO: 26901 - DNA, 17 bp, Homo sapiens
gatccagagggtggcgc

SEQ ID NO: 26902 - DNA, 17 bp, Homo sapiens
gatcaaaatctgtattt

SEQ ID NO: 26903 - DNA, 17 bp, Homo sapiens
gatcatcaccctgaaaa

SEQ ID NO: 26904 - DNA, 17 bp, Homo sapiens
gatcagctctccaagga

SEQ ID NO: 26905 - DNA, 17 bp, Homo sapiens
gatcctgcctctgttgt

SEQ ID NO: 26906 - DNA, 17 bp, Homo sapiens
gatctagataatttctg

SEQ ID NO: 26907 - DNA, 17 bp, Homo sapiens
gatcaccctttatattt

SEQ ID NO: 26908 - DNA, 17 bp, Homo sapiens
gatcctcatgtgtttgg

SEQ ID NO: 26909 - DNA, 17 bp, Homo sapiens
gatctatagcataaaac

SEQ ID NO: 26910 - DNA, 17 bp, Homo sapiens
gatcggaattttaatac

SEQ ID NO: 26911 - DNA, 17 bp, Homo sapiens
gatcctcccatttcatc

SEQ ID NO: 26912 - DNA, 17 bp, Homo sapiens
gatctttgccttataac

SEQ ID NO: 26913 - DNA, 17 bp, Homo sapiens
gatcctgcctgtcctgg

SEQ ID NO: 26914 - DNA, 17 bp, Homo sapiens
gatctatgtggtagtta

SEQ ID NO: 26915 - DNA, 17 bp, Homo sapiens
gatcccaaatatttcat

SEQ ID NO: 26916 - DNA, 17 bp, Homo sapiens
gatcctataggtgctct

SEQ ID NO: 26917 - DNA, 17 bp, Homo sapiens
gatctctaagacagcaa

SEQ ID NO: 26918 - DNA, 17 bp, Homo sapiens
gatcttttgggaacttg

SEQ ID NO: 26919 - DNA, 17 bp, Homo sapiens
gatctccagcttgcaga

SEQ ID NO: 26920 - DNA, 17 bp, Homo sapiens
gatcattctacctgaag

SEQ ID NO: 26921 - DNA, 17 bp, Homo sapiens
gatcactttgtagattc

SEQ ID NO: 26922 - DNA, 17 bp, Homo sapiens
gatctgtatcagttcca

SEQ ID NO: 26923 - DNA, 17 bp, Homo sapiens
gatcatacttaatatga

SEQ ID NO: 26924 - DNA, 17 bp, Homo sapiens
gatcatcgacctggcag

SEQ ID NO: 26925 - DNA, 17 bp, Homo sapiens
gatcatttgggaccagg

SEQ ID NO: 26926 - DNA, 17 bp, Homo sapiens
gatcccgtttttgtcag

SEQ ID NO: 26927 - DNA, 17 bp, Homo sapiens
gatcaacagcaaggatg

SEQ ID NO: 26928 - DNA, 17 bp, Homo sapiens
gatctaaaaggttcata

SEQ ID NO: 26929 - DNA, 17 bp, Homo sapiens
gatctctgccagttcat

SEQ ID NO: 26930 - DNA, 17 bp, Homo sapiens
gatctttgctcccagtg

SEQ ID NO: 26931 - DNA, 17 bp, Homo sapiens
gatcatcccaatattgt

SEQ ID NO: 26932 - DNA, 17 bp, Homo sapiens
gatcaaagaatgctgac

SEQ ID NO: 26933 - DNA, 17 bp, Homo sapiens
gatcctgagtagcctag

SEQ ID NO: 26934 - DNA, 17 bp, Homo sapiens
gatcatagctcaataca

SEQ ID NO: 26935 - DNA, 17 bp, Homo sapiens
gatcagttatcaggcaa

SEQ ID NO: 26936 - DNA, 17 bp, Homo sapiens
gatctgcagcgagaggg

SEQ ID NO: 26937 - DNA, 17 bp, Homo sapiens
gatccccccactttagc

SEQ ID NO: 26938 - DNA, 17 bp, Homo sapiens
gatccagctccttggtc

SEQ ID NO: 26939 - DNA, 17 bp, Homo sapiens
gatctgcctcgcacaga

SEQ ID NO: 26940 - DNA, 17 bp, Homo sapiens
gatcattcaccagtaca

SEQ ID NO: 26941 - DNA, 17 bp, Homo sapiens
gatccaagaactgtcat

SEQ ID NO: 26942 - DNA, 17 bp, Homo sapiens
gatccactccctgccca

SEQ ID NO: 26943 - DNA, 17 bp, Homo sapiens
gatctgaacttgcagtc

SEQ ID NO: 26944 - DNA, 17 bp, Homo sapiens
gatcttcatgccctgcg

SEQ ID NO: 26945 - DNA, 17 bp, Homo sapiens
gatccctttattctccc

SEQ ID NO: 26946 - DNA, 17 bp, Homo sapiens
gatcggctgcctcctgg

SEQ ID NO: 26947 - DNA, 17 bp, Homo sapiens
gatcactctcactagcc

SEQ ID NO: 26948 - DNA, 17 bp, Homo sapiens
gatctgccttgcataga

SEQ ID NO: 26949 - DNA, 17 bp, Homo sapiens
gatcaacaatttcatga

SEQ ID NO: 26950 - DNA, 17 bp, Homo sapiens
gatcaaaggcattcctt

SEQ ID NO: 26951 - DNA, 17 bp, Homo sapiens
gatctatggaatatttt

SEQ ID NO: 26952 - DNA, 17 bp, Homo sapiens
gatcacgcaaattacta

SEQ ID NO: 26953 - DNA, 17 bp, Homo sapiens
gatcctgtccaaccaac

SEQ ID NO: 26954 - DNA, 17 bp, Homo sapiens
gatcccataacagcctg

SEQ ID NO: 26955 - DNA, 17 bp, Homo sapiens
gatcatcttaggagagg

SEQ ID NO: 26956 - DNA, 17 bp, Homo sapiens
gatcctccagtggcttc

SEQ ID NO: 26957 - DNA, 17 bp, Homo sapiens
gatctacttgtgacttg

SEQ ID NO: 26958 - DNA, 17 bp, Homo sapiens
gatcatttttatctctc

SEQ ID NO: 26959 - DNA, 17 bp, Homo sapiens
gatctttttctccaccc

SEQ ID NO: 26960 - DNA, 17 bp, Homo sapiens
gatcgttaccagatgag

SEQ ID NO: 26961 - DNA, 17 bp, Homo sapiens
gatctggagaatcgaag

SEQ ID NO: 26962 - DNA, 17 bp, Homo sapiens
gatcctgacaaaaaaaa

SEQ ID NO: 26963 - DNA, 17 bp, Homo sapiens
gatccctttttgttttt

SEQ ID NO: 26964 - DNA, 17 bp, Homo sapiens
gatcttgaagattccct

SEQ ID NO: 26965 - DNA, 17 bp, Homo sapiens
gatctaaaagaaggttt

SEQ ID NO: 26966 - DNA, 17 bp, Homo sapiens
gatctttgggcaattct

SEQ ID NO: 26967 - DNA, 17 bp, Homo sapiens
gatctggcctggataga

SEQ ID NO: 26968 - DNA, 17 bp, Homo sapiens
gatcaccaatgtacctc

SEQ ID NO: 26969 - DNA, 17 bp, Homo sapiens
gatccagaatggagact

SEQ ID NO: 26970 - DNA, 17 bp, Homo sapiens
gatcataccacagcaca

SEQ ID NO: 26971 - DNA, 17 bp, Homo sapiens
gatcattactctccttg

SEQ ID NO: 26972 - DNA, 17 bp, Homo sapiens
gatcacttgaaaccaga

SEQ ID NO: 26973 - DNA, 17 bp, Homo sapiens
gatctgtggtcaagaat

SEQ ID NO: 26974 - DNA, 17 bp, Homo sapiens
gatcaaggctggctgta

SEQ ID NO: 26975 - DNA, 17 bp, Homo sapiens
gatcagccctgcccttc

SEQ ID NO: 26976 - DNA, 17 bp, Homo sapiens
gatcaagactggaaaat

SEQ ID NO: 26977 - DNA, 17 bp, Homo sapiens
gatcgtttagcaaacca

SEQ ID NO: 26978 - DNA, 17 bp, Homo sapiens
gatcgcttgacatcagg

SEQ ID NO: 26979 - DNA, 17 bp, Homo sapiens
gatcatcaacgagccca

SEQ ID NO: 26980 - DNA, 17 bp, Homo sapiens
gatctcaccagtgcagg

SEQ ID NO: 26981 - DNA, 17 bp, Homo sapiens
gatcagatgagaccttt

SEQ ID NO: 26982 - DNA, 17 bp, Homo sapiens
gatcttcccgtctaacc

SEQ ID NO: 26983 - DNA, 17 bp, Homo sapiens
gatctgtggactgtttg

SEQ ID NO: 26984 - DNA, 17 bp, Homo sapiens
gatcacatgtgctcctg

SEQ ID NO: 26985 - DNA, 17 bp, Homo sapiens
gatcagcaagacagtcc

SEQ ID NO: 26986 - DNA, 17 bp, Homo sapiens
gatcagcaaggactccc

SEQ ID NO: 26987 - DNA, 17 bp, Homo sapiens
gatccactctcccaaaa

SEQ ID NO: 26988 - DNA, 17 bp, Homo sapiens
gatcgttcctatacatt

SEQ ID NO: 26989 - DNA, 17 bp, Homo sapiens
gatctgctacttctaag

SEQ ID NO: 26990 - DNA, 17 bp, Homo sapiens
gatcagagtacacagta

SEQ ID NO: 26991 - DNA, 17 bp, Homo sapiens
gatctccactgaggcag

SEQ ID NO: 26992 - DNA, 17 bp, Homo sapiens
gatcctcactggcaccg

SEQ ID NO: 26993 - DNA, 17 bp, Homo sapiens
gatcaacagtgacagtt

SEQ ID NO: 26994 - DNA, 17 bp, Homo sapiens
gatcatctgacatttcc

SEQ ID NO: 26995 - DNA, 17 bp, Homo sapiens
gatccttagtttaggcc

SEQ ID NO: 26996 - DNA, 17 bp, Homo sapiens
gatcatgtctttccagt

SEQ ID NO: 26997 - DNA, 17 bp, Homo sapiens
gatccccaggctgcagg

SEQ ID NO: 26998 - DNA, 17 bp, Homo sapiens
gatctctgcacacccag

SEQ ID NO: 26999 - DNA, 17 bp, Homo sapiens
gatcaggagaagaagga

SEQ ID NO: 27000 - DNA, 17 bp, Homo sapiens
gatcacaattctctaaa

SEQ ID NO: 27001 - DNA, 17 bp, Homo sapiens
gatccaggtaacgagtt

SEQ ID NO: 27002 - DNA, 17 bp, Homo sapiens
gatctccatgttctcat

SEQ ID NO: 27003 - DNA, 17 bp, Homo sapiens
gatccagagctggggca

SEQ ID NO: 27004 - DNA, 17 bp, Homo sapiens
gatctgtatgtcaggga

SEQ ID NO: 27005 - DNA, 17 bp, Homo sapiens
gatctatcccagattgc

SEQ ID NO: 27006 - DNA, 17 bp, Homo sapiens
gatccactaaaacagat

SEQ ID NO: 27007 - DNA, 17 bp, Homo sapiens
gatctctctctttttct

SEQ ID NO: 27008 - DNA, 17 bp, Homo sapiens
gatcaactatgacatct

SEQ ID NO: 27009 - DNA, 17 bp, Homo sapiens
gatcccttggactccgt

SEQ ID NO: 27010 - DNA, 17 bp, Homo sapiens
gatcatatgaaaatatt

SEQ ID NO: 27011 - DNA, 17 bp, Homo sapiens
gatctgaagaatcacac

SEQ ID NO: 27012 - DNA, 17 bp, Homo sapiens
gatcatgtatgtatacc

SEQ ID NO: 27013 - DNA, 17 bp, Homo sapiens
gatcatggaaatcacaa

SEQ ID NO: 27014 - DNA, 17 bp, Homo sapiens
gatcaggcagtctgctc

SEQ ID NO: 27015 - DNA, 17 bp, Homo sapiens
gatcagcagcattagca

SEQ ID NO: 27016 - DNA, 17 bp, Homo sapiens
gatcaaattctggcagt

SEQ ID NO: 27017 - DNA, 17 bp, Homo sapiens
gatccattcattctgct

SEQ ID NO: 27018 - DNA, 17 bp, Homo sapiens
gatctctcttgatatgg

SEQ ID NO: 27019 - DNA, 17 bp, Homo sapiens
gatcagaaagaatgaat

SEQ ID NO: 27020 - DNA, 17 bp, Homo sapiens
gatcatcttctacagcc

SEQ ID NO: 27021 - DNA, 17 bp, Homo sapiens
gatcatctcataaatag

SEQ ID NO: 27022 - DNA, 17 bp, Homo sapiens
gatctcagcagcccagt

SEQ ID NO: 27023 - DNA, 17 bp, Homo sapiens
gatcaagctcttcccaa

SEQ ID NO: 27024 - DNA, 17 bp, Homo sapiens
gatctgtagacttttga

SEQ ID NO: 27025 - DNA, 17 bp, Homo sapiens
gatctgctttgcaatac

SEQ ID NO: 27026 - DNA, 17 bp, Homo sapiens
gatctgagcatgtcacc

SEQ ID NO: 27027 - DNA, 17 bp, Homo sapiens
gatccctagaggcttgt

SEQ ID NO: 27028 - DNA, 17 bp, Homo sapiens
gatcgctttctgcaggc

SEQ ID NO: 27029 - DNA, 17 bp, Homo sapiens
gatcatacacacgtttt

SEQ ID NO: 27030 - DNA, 17 bp, Homo sapiens
gatcaactgaatttctt

SEQ ID NO: 27031 - DNA, 17 bp, Homo sapiens
gatcctgagcctgaagg

SEQ ID NO: 27032 - DNA, 17 bp, Homo sapiens
gatcatcgtaagacatt

SEQ ID NO: 27033 - DNA, 17 bp, Homo sapiens
gatctggctatgatatg

SEQ ID NO: 27034 - DNA, 17 bp, Homo sapiens
gatcttagcgctgtcct

SEQ ID NO: 27035 - DNA, 17 bp, Homo sapiens
gatcatgtttgtgcctt

SEQ ID NO: 27036 - DNA, 17 bp, Homo sapiens
gatctgtttattgcagg

SEQ ID NO: 27037 - DNA, 17 bp, Homo sapiens
gatctattgataaacaa

SEQ ID NO: 27038 - DNA, 17 bp, Homo sapiens
gatccagtggggacatt

SEQ ID NO: 27039 - DNA, 17 bp, Homo sapiens
gatctgaatcactgtgc

SEQ ID NO: 27040 - DNA, 17 bp, Homo sapiens
gatccattctgagttaa

SEQ ID NO: 27041 - DNA, 17 bp, Homo sapiens
gatccccagagcagggg

SEQ ID NO: 27042 - DNA, 17 bp, Homo sapiens
gatctgcttccaagctc

SEQ ID NO: 27043 - DNA, 17 bp, Homo sapiens
gatcaccctcctctcag

SEQ ID NO: 27044 - DNA, 17 bp, Homo sapiens
gatccccatggccacag

SEQ ID NO: 27045 - DNA, 17 bp, Homo sapiens
gatcagcgtggccactg

SEQ ID NO: 27046 - DNA, 17 bp, Homo sapiens
gatctcccggacccctg

SEQ ID NO: 27047 - DNA, 17 bp, Homo sapiens
gatcttcgacattcaga

SEQ ID NO: 27048 - DNA, 17 bp, Homo sapiens
gatcctcattctaccca

SEQ ID NO: 27049 - DNA, 17 bp, Homo sapiens
gatcctggccttccagc

SEQ ID NO: 27050 - DNA, 17 bp, Homo sapiens
gatcagccttcactgta

SEQ ID NO: 27051 - DNA, 17 bp, Homo sapiens
gatctaactccaagtgc

SEQ ID NO: 27052 - DNA, 17 bp, Homo sapiens
gatcagaaggtccatgc

SEQ ID NO: 27053 - DNA, 17 bp, Homo sapiens
gatcccgggtgaggagt

SEQ ID NO: 27054 - DNA, 17 bp, Homo sapiens
gatcccaaggcatggtc

SEQ ID NO: 27055 - DNA, 17 bp, Homo sapiens
gatccgctacgagggca

SEQ ID NO: 27056 - DNA, 17 bp, Homo sapiens
gatccacgaggacctaa

SEQ ID NO: 27057 - DNA, 17 bp, Homo sapiens
gatcttaaaaactaact

SEQ ID NO: 27058 - DNA, 17 bp, Homo sapiens
gatcagtaagcacttga

SEQ ID NO: 27059 - DNA, 17 bp, Homo sapiens
gatcaaacaaaaatgca

SEQ ID NO: 27060 - DNA, 17 bp, Homo sapiens
gatcaccgtgtgctcaa

SEQ ID NO: 27061 - DNA, 17 bp, Homo sapiens
gatcactcaaaatgtgt

SEQ ID NO: 27062 - DNA, 17 bp, Homo sapiens
gatccctgcgttttcac

SEQ ID NO: 27063 - DNA, 17 bp, Homo sapiens
gatctctgagtaactaa

SEQ ID NO: 27064 - DNA, 17 bp, Homo sapiens
gatcaatttgtcacaat

SEQ ID NO: 27065 - DNA, 17 bp, Homo sapiens
gatctttacaacatttt

SEQ ID NO: 27066 - DNA, 17 bp, Homo sapiens
gatcaactacagtagaa

SEQ ID NO: 27067 - DNA, 17 bp, Homo sapiens
gatcactaacaaaataa

SEQ ID NO: 27068 - DNA, 17 bp, Homo sapiens
gatcatgactctctggg

SEQ ID NO: 27069 - DNA, 17 bp, Homo sapiens
gatcctagtcttaggag

SEQ ID NO: 27070 - DNA, 17 bp, Homo sapiens
gatcacaaatggggaaa

SEQ ID NO: 27071 - DNA, 17 bp, Homo sapiens
gatctctacaaggcaaa

SEQ ID NO: 27072 - DNA, 17 bp, Homo sapiens
gatcttgggggtctcag

SEQ ID NO: 27073 - DNA, 17 bp, Homo sapiens
gatccgccagcacccag

SEQ ID NO: 27074 - DNA, 17 bp, Homo sapiens
gatctgtacacaacttt

SEQ ID NO: 27075 - DNA, 17 bp, Homo sapiens
gatcagattaaggaaat

SEQ ID NO: 27076 - DNA, 17 bp, Homo sapiens
gatcttttacactcaaa

SEQ ID NO: 27077 - DNA, 17 bp, Homo sapiens
gatctgtcaggtcaacc

SEQ ID NO: 27078 - DNA, 17 bp, Homo sapiens
gatctagcactgaaaca

SEQ ID NO: 27079 - DNA, 17 bp, Homo sapiens
gatcttcccctggaagg

SEQ ID NO: 27080 - DNA, 17 bp, Homo sapiens
gatctaggctgaggtgt

SEQ ID NO: 27081 - DNA, 17 bp, Homo sapiens
gatcatccttatttagg

SEQ ID NO: 27082 - DNA, 17 bp, Homo sapiens
gatccatgttaggacat

SEQ ID NO: 27083 - DNA, 17 bp, Homo sapiens
gatccattttcttcttc

SEQ ID NO: 27084 - DNA, 17 bp, Homo sapiens
gatctctttaataaaga

SEQ ID NO: 27085 - DNA, 17 bp, Homo sapiens
gatcaagaaagaatccc

SEQ ID NO: 27086 - DNA, 17 bp, Homo sapiens
gatcttatttctatctt

SEQ ID NO: 27087 - DNA, 17 bp, Homo sapiens
gatctttgccttcttcc

SEQ ID NO: 27088 - DNA, 17 bp, Homo sapiens
gatcattttggcatctg

SEQ ID NO: 27089 - DNA, 17 bp, Homo sapiens
gatcatcacccctgcac

SEQ ID NO: 27090 - DNA, 17 bp, Homo sapiens
gatcttaaccgacttgc

SEQ ID NO: 27091 - DNA, 17 bp, Homo sapiens
gatcccactgctccata

SEQ ID NO: 27092 - DNA, 17 bp, Homo sapiens
gatctactgtgtggtgt

SEQ ID NO: 27093 - DNA, 17 bp, Homo sapiens
gatcaaaggttttgtaa

SEQ ID NO: 27094 - DNA, 17 bp, Homo sapiens
gatccttgtttttttcc

SEQ ID NO: 27095 - DNA, 17 bp, Homo sapiens
gatcagaaaaagagaaa

SEQ ID NO: 27096 - DNA, 17 bp, Homo sapiens
gatccgtagagtaactt

SEQ ID NO: 27097 - DNA, 17 bp, Homo sapiens
gatcacaactcactgta

SEQ ID NO: 27098 - DNA, 17 bp, Homo sapiens
gatcccaagactctcac

SEQ ID NO: 27099 - DNA, 17 bp, Homo sapiens
gatcatctctgcccgcc

SEQ ID NO: 27100 - DNA, 17 bp, Homo sapiens
gatcacatctgtcaaat

SEQ ID NO: 27101 - DNA, 17 bp, Homo sapiens
gatcccggaaagaacac

SEQ ID NO: 27102 - DNA, 17 bp, Homo sapiens
gatcccaataacctgta

SEQ ID NO: 27103 - DNA, 17 bp, Homo sapiens
gatcaaacacttcttgg

SEQ ID NO: 27104 - DNA, 17 bp, Homo sapiens
gatcaagtgaatagcac

SEQ ID NO: 27105 - DNA, 17 bp, Homo sapiens
gatccaaggtgtatgaa

SEQ ID NO: 27106 - DNA, 17 bp, Homo sapiens
gatctggctggagaagc

SEQ ID NO: 27107 - DNA, 17 bp, Homo sapiens
gatcagaagggaatggt

SEQ ID NO: 27108 - DNA, 17 bp, Homo sapiens
gatctgaaataaaagtg

SEQ ID NO: 27109 - DNA, 17 bp, Homo sapiens
gatctatgaatgattta

SEQ ID NO: 27110 - DNA, 17 bp, Homo sapiens
gatctatgtctgagtca

SEQ ID NO: 27111 - DNA, 17 bp, Homo sapiens
gatcctcattgttggtc

SEQ ID NO: 27112 - DNA, 17 bp, Homo sapiens
gatctgagatgctgcct

SEQ ID NO: 27113 - DNA, 17 bp, Homo sapiens
gatctagtgctcagaac

SEQ ID NO: 27114 - DNA, 17 bp, Homo sapiens
gatctaatatttggcta

SEQ ID NO: 27115 - DNA, 17 bp, Homo sapiens
gatcttcaacgcagcag

SEQ ID NO: 27116 - DNA, 17 bp, Homo sapiens
gatcttttacaaaacat

SEQ ID NO: 27117 - DNA, 17 bp, Homo sapiens
gatcagaccaaaagctg

SEQ ID NO: 27118 - DNA, 17 bp, Homo sapiens
gatcctggggctgggga

SEQ ID NO: 27119 - DNA, 17 bp, Homo sapiens
gatccccttccaatcta

SEQ ID NO: 27120 - DNA, 17 bp, Homo sapiens
gatccaaaaggcagcag

SEQ ID NO: 27121 - DNA, 17 bp, Homo sapiens
gatcgtatttggcaggg

SEQ ID NO: 27122 - DNA, 17 bp, Homo sapiens
gatcttgagcaacaagg

SEQ ID NO: 27123 - DNA, 17 bp, Homo sapiens
gatcagggaccatggaa

SEQ ID NO: 27124 - DNA, 17 bp, Homo sapiens
gatccacaagactaaag

SEQ ID NO: 27125 - DNA, 17 bp, Homo sapiens
gatccccagaatgtgta

SEQ ID NO: 27126 - DNA, 17 bp, Homo sapiens
gatcttcaacagctcaa

SEQ ID NO: 27127 - DNA, 17 bp, Homo sapiens
gatcacctgaaaacaca

SEQ ID NO: 27128 - DNA, 17 bp, Homo sapiens
gatcatcttatgttcaa

SEQ ID NO: 27129 - DNA, 17 bp, Homo sapiens
gatctttgagaaacacc

SEQ ID NO: 27130 - DNA, 17 bp, Homo sapiens
gatcccatatttctacc

SEQ ID NO: 27131 - DNA, 17 bp, Homo sapiens
gatctgtgctcaaggga

SEQ ID NO: 27132 - DNA, 17 bp, Homo sapiens
gatcccagtgtgatgta

SEQ ID NO: 27133 - DNA, 17 bp, Homo sapiens
gatctaagacatttaat

SEQ ID NO: 27134 - DNA, 17 bp, Homo sapiens
gatctaattttctcttg

SEQ ID NO: 27135 - DNA, 17 bp, Homo sapiens
gatccatattttgtttt

SEQ ID NO: 27136 - DNA, 17 bp, Homo sapiens
gatcacaacctgaatgg

SEQ ID NO: 27137 - DNA, 17 bp, Homo sapiens
gatcctccacaagtagg

SEQ ID NO: 27138 - DNA, 17 bp, Homo sapiens
gatctctttcagaagaa

SEQ ID NO: 27139 - DNA, 17 bp, Homo sapiens
gatcccccaaaaaaaac

SEQ ID NO: 27140 - DNA, 17 bp, Homo sapiens
gatccatggaggggcat

SEQ ID NO: 27141 - DNA, 17 bp, Homo sapiens
gatctaaatgatattta

SEQ ID NO: 27142 - DNA, 17 bp, Homo sapiens
gatcttgtaagaacttt

SEQ ID NO: 27143 - DNA, 17 bp, Homo sapiens
gatcaacaagaaatgta

SEQ ID NO: 27144 - DNA, 17 bp, Homo sapiens
gatcctatattggtatg

SEQ ID NO: 27145 - DNA, 17 bp, Homo sapiens
gatctcaaactgaaatc

SEQ ID NO: 27146 - DNA, 17 bp, Homo sapiens
gatcccacaggagtttg

SEQ ID NO: 27147 - DNA, 17 bp, Homo sapiens
gatcaaaaaaacaccga

SEQ ID NO: 27148 - DNA, 17 bp, Homo sapiens
gatcccaatttccagat

SEQ ID NO: 27149 - DNA, 17 bp, Homo sapiens
gatcgctgcaaaatcag

SEQ ID NO: 27150 - DNA, 17 bp, Homo sapiens
gatcttggcttttgttg

SEQ ID NO: 27151 - DNA, 17 bp, Homo sapiens
gatcccttttctgtaaa

SEQ ID NO: 27152 - DNA, 17 bp, Homo sapiens
gatcatggggtcatcct

SEQ ID NO: 27153 - DNA, 17 bp, Homo sapiens
gatcgacacatgccggg

SEQ ID NO: 27154 - DNA, 17 bp, Homo sapiens
gatctaatcacttttta

SEQ ID NO: 27155 - DNA, 17 bp, Homo sapiens
gatcagtccactttctc

SEQ ID NO: 27156 - DNA, 17 bp, Homo sapiens
gatcgggctgaggccag

SEQ ID NO: 27157 - DNA, 17 bp, Homo sapiens
gatcagagccatccaga

SEQ ID NO: 27158 - DNA, 17 bp, Homo sapiens
gatccttttcagatatg

SEQ ID NO: 27159 - DNA, 17 bp, Homo sapiens
gatcctgaccacagagt

SEQ ID NO: 27160 - DNA, 17 bp, Homo sapiens
gatcacttgagcctggt

SEQ ID NO: 27161 - DNA, 17 bp, Homo sapiens
gatctgagagtggcaac

SEQ ID NO: 27162 - DNA, 17 bp, Homo sapiens
gatcttcctggtggtgt

SEQ ID NO: 27163 - DNA, 17 bp, Homo sapiens
gatctagtttaattttt

SEQ ID NO: 27164 - DNA, 17 bp, Homo sapiens
gatcgtcggttttgcta

SEQ ID NO: 27165 - DNA, 17 bp, Homo sapiens
gatctctgcgggcaaca

SEQ ID NO: 27166 - DNA, 17 bp, Homo sapiens
gatccactccttgtgct

SEQ ID NO: 27167 - DNA, 17 bp, Homo sapiens
gatctcagcttcagttc

SEQ ID NO: 27168 - DNA, 17 bp, Homo sapiens
gatcctcctggccccag

SEQ ID NO: 27169 - DNA, 17 bp, Homo sapiens
gatcctgagactccgga

SEQ ID NO: 27170 - DNA, 17 bp, Homo sapiens
gatcccagcatccttgg

SEQ ID NO: 27171 - DNA, 17 bp, Homo sapiens
gatcaagtgttcatttt

SEQ ID NO: 27172 - DNA, 17 bp, Homo sapiens
gatctgtttcccatcat

SEQ ID NO: 27173 - DNA, 17 bp, Homo sapiens
gatcagataccaaacat

SEQ ID NO: 27174 - DNA, 17 bp, Homo sapiens
gatccttaatggatgtg

SEQ ID NO: 27175 - DNA, 17 bp, Homo sapiens
gatcaggagtaagatga

SEQ ID NO: 27176 - DNA, 17 bp, Homo sapiens
gatctcctctttggtgt

SEQ ID NO: 27177 - DNA, 17 bp, Homo sapiens
gatcaacatttattgaa

SEQ ID NO: 27178 - DNA, 17 bp, Homo sapiens
gatccagtttgtgagaa

SEQ ID NO: 27179 - DNA, 17 bp, Homo sapiens
gatccatcaggctttgg

SEQ ID NO: 27180 - DNA, 17 bp, Homo sapiens
gatccagatacctgaat

SEQ ID NO: 27181 - DNA, 17 bp, Homo sapiens
gatcctatcactacaaa

SEQ ID NO: 27182 - DNA, 17 bp, Homo sapiens
gatcatgtcgctgcact

SEQ ID NO: 27183 - DNA, 17 bp, Homo sapiens
gatctccacaccaccct

SEQ ID NO: 27184 - DNA, 17 bp, Homo sapiens
gatcccatctttgtcct

SEQ ID NO: 27185 - DNA, 17 bp, Homo sapiens
gatctatggtcatcaaa

SEQ ID NO: 27186 - DNA, 17 bp, Homo sapiens
gatctgtatgtgtgtgt

SEQ ID NO: 27187 - DNA, 17 bp, Homo sapiens
gatcccaaagaaaagga

SEQ ID NO: 27188 - DNA, 17 bp, Homo sapiens
gatcaaacatctttaat

SEQ ID NO: 27189 - DNA, 17 bp, Homo sapiens
gatccagaatgaatgtg

SEQ ID NO: 27190 - DNA, 17 bp, Homo sapiens
gatccttgtgtatattg

SEQ ID NO: 27191 - DNA, 17 bp, Homo sapiens
gatcttggctcacctcc

SEQ ID NO: 27192 - DNA, 17 bp, Homo sapiens
gatctaggtatgttctg

SEQ ID NO: 27193 - DNA, 17 bp, Homo sapiens
gatccaaaagtcttagt

SEQ ID NO: 27194 - DNA, 17 bp, Homo sapiens
gatctgttcttcaatct

SEQ ID NO: 27195 - DNA, 17 bp, Homo sapiens
gatcatacagacaggac

SEQ ID NO: 27196 - DNA, 17 bp, Homo sapiens
gatcctcccgcccttgg

SEQ ID NO: 27197 - DNA, 17 bp, Homo sapiens
gatctctgaatgccctg

SEQ ID NO: 27198 - DNA, 17 bp, Homo sapiens
gatccctccagacagca

SEQ ID NO: 27199 - DNA, 17 bp, Homo sapiens
gatcctaaactacccat

SEQ ID NO: 27200 - DNA, 17 bp, Homo sapiens
gatcaaattgaaaagtt

SEQ ID NO: 27201 - DNA, 17 bp, Homo sapiens
gatcacttgtaacaaaa

SEQ ID NO: 27202 - DNA, 17 bp, Homo sapiens
gatctcaggtatgcttt

SEQ ID NO: 27203 - DNA, 17 bp, Homo sapiens
gatctgtgttcctgcag

SEQ ID NO: 27204 - DNA, 17 bp, Homo sapiens
gatctgcctcctgaaag

SEQ ID NO: 27205 - DNA, 17 bp, Homo sapiens
gatcatttacttctcta

SEQ ID NO: 27206 - DNA, 17 bp, Homo sapiens
gatctttattttgacat

SEQ ID NO: 27207 - DNA, 17 bp, Homo sapiens
gatctacaaaaaaaaaa

SEQ ID NO: 27208 - DNA, 17 bp, Homo sapiens
gatctcactcatcataa

SEQ ID NO: 27209 - DNA, 17 bp, Homo sapiens
gatctgtcctccaagaa

SEQ ID NO: 27210 - DNA, 17 bp, Homo sapiens
gatcaggaagattattg

SEQ ID NO: 27211 - DNA, 17 bp, Homo sapiens
gatcctttgcgagctaa

SEQ ID NO: 27212 - DNA, 17 bp, Homo sapiens
gatctgattgttctgcc

SEQ ID NO: 27213 - DNA, 17 bp, Homo sapiens
gatctctaggaatacca

SEQ ID NO: 27214 - DNA, 17 bp, Homo sapiens
gatccttagaactgtgc

SEQ ID NO: 27215 - DNA, 17 bp, Homo sapiens
gatctgtgcatcactct

SEQ ID NO: 27216 - DNA, 17 bp, Homo sapiens
gatccagagtttgttag

SEQ ID NO: 27217 - DNA, 17 bp, Homo sapiens
gatcgaaattcccaaaa

SEQ ID NO: 27218 - DNA, 17 bp, Homo sapiens
gatcgtcacaattccaa

SEQ ID NO: 27219 - DNA, 17 bp, Homo sapiens
gatcttaaaatgcctgt

SEQ ID NO: 27220 - DNA, 17 bp, Homo sapiens
gatcaggttagggcgat

SEQ ID NO: 27221 - DNA, 17 bp, Homo sapiens
gatctgctttttctttt

SEQ ID NO: 27222 - DNA, 17 bp, Homo sapiens
gatccaaggtcatgata

SEQ ID NO: 27223 - DNA, 17 bp, Homo sapiens
gatcaggttaagcctgc

SEQ ID NO: 27224 - DNA, 17 bp, Homo sapiens
gatcagcttcactcagg

SEQ ID NO: 27225 - DNA, 17 bp, Homo sapiens
gatcaaatagagggaag

SEQ ID NO: 27226 - DNA, 17 bp, Homo sapiens
gatcttggctaatgtgt

SEQ ID NO: 27227 - DNA, 17 bp, Homo sapiens
gatcgttcacttcctaa

SEQ ID NO: 27228 - DNA, 17 bp, Homo sapiens
gatccccccacagcctg

SEQ ID NO: 27229 - DNA, 17 bp, Homo sapiens
gatccccaagtaagaaa

SEQ ID NO: 27230 - DNA, 17 bp, Homo sapiens
gatccattgattaacag

SEQ ID NO: 27231 - DNA, 17 bp, Homo sapiens
gatcagcatcatctctg

SEQ ID NO: 27232 - DNA, 17 bp, Homo sapiens
gatcaaagcaaatgtgg

SEQ ID NO: 27233 - DNA, 17 bp, Homo sapiens
gatcaaatatacagaaa

SEQ ID NO: 27234 - DNA, 17 bp, Homo sapiens
gatcaagatgaaaaggt

SEQ ID NO: 27235 - DNA, 17 bp, Homo sapiens
gatcccacaacgattta

SEQ ID NO: 27236 - DNA, 17 bp, Homo sapiens
gatcaaaactgtaacat

SEQ ID NO: 27237 - DNA, 17 bp, Homo sapiens
gatcaatgtgcagaatt

SEQ ID NO: 27238 - DNA, 17 bp, Homo sapiens
gatctcattttcactgt

SEQ ID NO: 27239 - DNA, 17 bp, Homo sapiens
gatcctcaaaaaagtct

SEQ ID NO: 27240 - DNA, 17 bp, Homo sapiens
gatctgatgctgacact

SEQ ID NO: 27241 - DNA, 17 bp, Homo sapiens
gatcacaaactttgaat

SEQ ID NO: 27242 - DNA, 17 bp, Homo sapiens
gatcacacccgattcga

SEQ ID NO: 27243 - DNA, 17 bp, Homo sapiens
gatctgcaccagaaccc

SEQ ID NO: 27244 - DNA, 17 bp, Homo sapiens
gatctccagttaaataa

SEQ ID NO: 27245 - DNA, 17 bp, Homo sapiens
gatcaccttgtgcaaac

SEQ ID NO: 27246 - DNA, 17 bp, Homo sapiens
gatcctttgtgtacctt

SEQ ID NO: 27247 - DNA, 17 bp, Homo sapiens
gatctggatggcaagac

SEQ ID NO: 27248 - DNA, 17 bp, Homo sapiens
gatctttcttccctgtt

SEQ ID NO: 27249 - DNA, 17 bp, Homo sapiens
gatccttcttacatgca

SEQ ID NO: 27250 - DNA, 17 bp, Homo sapiens
gatcactcctggaggct

SEQ ID NO: 27251 - DNA, 17 bp, Homo sapiens
gatccttagttaattag

SEQ ID NO: 27252 - DNA, 17 bp, Homo sapiens
gatcctacccaaaaagc

SEQ ID NO: 27253 - DNA, 17 bp, Homo sapiens
gatccgaaaaaaaatac

SEQ ID NO: 27254 - DNA, 17 bp, Homo sapiens
gatcccacagtgataac

SEQ ID NO: 27255 - DNA, 17 bp, Homo sapiens
gatcccccaccccttgc

SEQ ID NO: 27256 - DNA, 17 bp, Homo sapiens
gatcttcagtgttgtct

SEQ ID NO: 27257 - DNA, 17 bp, Homo sapiens
gatcaaaaaatgaacgg

SEQ ID NO: 27258 - DNA, 17 bp, Homo sapiens
gatcaatcaaatggtga

SEQ ID NO: 27259 - DNA, 17 bp, Homo sapiens
gatctgtctctgagacc

SEQ ID NO: 27260 - DNA, 17 bp, Homo sapiens
gatccaacagtaaaggc

SEQ ID NO: 27261 - DNA, 17 bp, Homo sapiens
gatccaaatgaaactca

SEQ ID NO: 27262 - DNA, 17 bp, Homo sapiens
gatctgtctcctgcccc

SEQ ID NO: 27263 - DNA, 17 bp, Homo sapiens
gatccccagatgattcc

SEQ ID NO: 27264 - DNA, 17 bp, Homo sapiens
gatcttttctttcttta

SEQ ID NO: 27265 - DNA, 17 bp, Homo sapiens
gatcaagacttcaaatc

SEQ ID NO: 27266 - DNA, 17 bp, Homo sapiens
gatcagttgcagagagg

SEQ ID NO: 27267 - DNA, 17 bp, Homo sapiens
gatccaggatggtgggg

SEQ ID NO: 27268 - DNA, 17 bp, Homo sapiens
gatcctctccagcagcc

SEQ ID NO: 27269 - DNA, 17 bp, Homo sapiens
gatcatttcaatgcggg

SEQ ID NO: 27270 - DNA, 17 bp, Homo sapiens
gatcctttggtagtcaa

SEQ ID NO: 27271 - DNA, 17 bp, Homo sapiens
gatcccaacacacgcag

SEQ ID NO: 27272 - DNA, 17 bp, Homo sapiens
gatcccagcagtgatgt

SEQ ID NO: 27273 - DNA, 17 bp, Homo sapiens
gatctcaaggatgtaat

SEQ ID NO: 27274 - DNA, 17 bp, Homo sapiens
gatcctgcagagaatat

SEQ ID NO: 27275 - DNA, 17 bp, Homo sapiens
gatctcagcatctgtgg

SEQ ID NO: 27276 - DNA, 17 bp, Homo sapiens
gatctggcccagaggga

SEQ ID NO: 27277 - DNA, 17 bp, Homo sapiens
gatcttggctctggtct

SEQ ID NO: 27278 - DNA, 17 bp, Homo sapiens
gatcctgaaaatagccc

SEQ ID NO: 27279 - DNA, 17 bp, Homo sapiens
gatctcaccaaagacga

SEQ ID NO: 27280 - DNA, 17 bp, Homo sapiens
gatctggtactcggaat

SEQ ID NO: 27281 - DNA, 17 bp, Homo sapiens
gatctcaactaaaccta

SEQ ID NO: 27282 - DNA, 17 bp, Homo sapiens
gatctgaaggtctatgg

SEQ ID NO: 27283 - DNA, 17 bp, Homo sapiens
gatctggagcatcggct

SEQ ID NO: 27284 - DNA, 17 bp, Homo sapiens
gatccctacaactcaga

SEQ ID NO: 27285 - DNA, 17 bp, Homo sapiens
gatcctcttgtgaccaa

SEQ ID NO: 27286 - DNA, 17 bp, Homo sapiens
gatccacgaactcagca

SEQ ID NO: 27287 - DNA, 17 bp, Homo sapiens
gatctgagccttctctc

SEQ ID NO: 27288 - DNA, 17 bp, Homo sapiens
gatcggcgaggtggatt

SEQ ID NO: 27289 - DNA, 17 bp, Homo sapiens
gatctcttcagtccagg

SEQ ID NO: 27290 - DNA, 17 bp, Homo sapiens
gatctgtaaatgtctat

SEQ ID NO: 27291 - DNA, 17 bp, Homo sapiens
gatcacagcaatccaca

SEQ ID NO: 27292 - DNA, 17 bp, Homo sapiens
gatcctttgccttgaca

SEQ ID NO: 27293 - DNA, 17 bp, Homo sapiens
gatctctacaatctttt

SEQ ID NO: 27294 - DNA, 17 bp, Homo sapiens
gatcagatgatagaggt

SEQ ID NO: 27295 - DNA, 17 bp, Homo sapiens
gatccaaaccaggcccc

SEQ ID NO: 27296 - DNA, 17 bp, Homo sapiens
gatcccttgaggtcaga

SEQ ID NO: 27297 - DNA, 17 bp, Homo sapiens
gatcttaatgactttca

SEQ ID NO: 27298 - DNA, 17 bp, Homo sapiens
gatctagaaatttttac

SEQ ID NO: 27299 - DNA, 17 bp, Homo sapiens
gatcgatacagtggcaa

SEQ ID NO: 27300 - DNA, 17 bp, Homo sapiens
gatctaaatgtctcaga

SEQ ID NO: 27301 - DNA, 17 bp, Homo sapiens
gatcacagtgggattaa

SEQ ID NO: 27302 - DNA, 17 bp, Homo sapiens
gatccgtttgcaattat

SEQ ID NO: 27303 - DNA, 17 bp, Homo sapiens
gatcgtgttaattatta

SEQ ID NO: 27304 - DNA, 17 bp, Homo sapiens
gatcttttcattgtgga

SEQ ID NO: 27305 - DNA, 17 bp, Homo sapiens
gatctgactttggtgat

SEQ ID NO: 27306 - DNA, 17 bp, Homo sapiens
gatcatttatcagaaag

SEQ ID NO: 27307 - DNA, 17 bp, Homo sapiens
gatcttagtcttggtgg

SEQ ID NO: 27308 - DNA, 17 bp, Homo sapiens
gatctttgcctgctctt

SEQ ID NO: 27309 - DNA, 17 bp, Homo sapiens
gatccattagtaattta

SEQ ID NO: 27310 - DNA, 17 bp, Homo sapiens
gatcacagtctgaccac

SEQ ID NO: 27311 - DNA, 17 bp, Homo sapiens
gatcatttctcttcccc

SEQ ID NO: 27312 - DNA, 17 bp, Homo sapiens
gatcaaaatggagatag

SEQ ID NO: 27313 - DNA, 17 bp, Homo sapiens
gatcttactgatgtaca

SEQ ID NO: 27314 - DNA, 17 bp, Homo sapiens
gatcatgtgggtgagtt

SEQ ID NO: 27315 - DNA, 17 bp, Homo sapiens
gatcccccctcctccct

SEQ ID NO: 27316 - DNA, 17 bp, Homo sapiens
gatcctatatacaatat

SEQ ID NO: 27317 - DNA, 17 bp, Homo sapiens
gatccttaattatatct

SEQ ID NO: 27318 - DNA, 17 bp, Homo sapiens
gatctgcctgggcctcc

SEQ ID NO: 27319 - DNA, 17 bp, Homo sapiens
gatcatggtgcggcaaa

SEQ ID NO: 27320 - DNA, 17 bp, Homo sapiens
gatccactgtggctgct

SEQ ID NO: 27321 - DNA, 17 bp, Homo sapiens
gatccacccgcctggac

SEQ ID NO: 27322 - DNA, 17 bp, Homo sapiens
gatcgggcttttaaaaa

SEQ ID NO: 27323 - DNA, 17 bp, Homo sapiens
gatcccaagcaagtctc

SEQ ID NO: 27324 - DNA, 17 bp, Homo sapiens
gatccttttaacaatcg

SEQ ID NO: 27325 - DNA, 17 bp, Homo sapiens
gatcttcttctatatca

SEQ ID NO: 27326 - DNA, 17 bp, Homo sapiens
gatcatttctaggtgga

SEQ ID NO: 27327 - DNA, 17 bp, Homo sapiens
gatcaaatgaaaacagc

SEQ ID NO: 27328 - DNA, 17 bp, Homo sapiens
gatctcagtcttgcaga

SEQ ID NO: 27329 - DNA, 17 bp, Homo sapiens
gatcaggaagacagtgg

SEQ ID NO: 27330 - DNA, 5260 bp, Homo sapiens
ctctggtgacattttcttgggggcggcgcggacgactgaagggacttggtggtagaggctgcggaggcggcgaggttcactttggtcccggcaggggctctgaccgcgacccactgctcgctgccggggcttgttccgaggaggagaaggcggcggtggccgtcgcgtcctgagtcaccgcagcggggaagagtcccggccgggggttcggtgcgtgccccgacggggcgcgcgcgaagcgagcgagaaggcacggagtcgccgcggagcgcaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccaggtcatttggatccaggattcctagcaagtgacaaaacatctgctggcaatgcgccactcaatgaagaaattaacattgcgtcttcagatagtgaagtagagattgtgggagttcaggaacatgcaaggtgtgttcatcctcgaggtggtgtgattcagagtgtttcttcatggaagcatggctcgggcacgcagtatgttagcaccaggcaaacacagtcatggactgctgtgactccccagcagacttgggcttcaccagcagaagttgttgaccttaccttggatgaggatagcaggcgtaaatacctactgtaatacaatgtcactgtgtttcctctgcactgttcccttccacttcctcatcctctttgtgacatggaagttcattgtcatagcttcagcttcagaagctgtttgtggcatttgtaggattcaaactcatggaaaattccctcctcttcccccctttttttaattaaaagaagtcacttaggaaaataacatcacagagaaaagaatttcttctttccctcagtaggaatatagaatgatgaattttattagacaactttattttacttggtgacttttaatcttaggaaactctgccttccttttagaataatattttaattgccaggcaaaatgggtttcagtttttgaatcttgtatttatttttctgtataatgaaattaatatctagacttgaccactatctgcccaccccattggcactcccatcttagggcattcgcacacatatcagtcaggtccttattggcacctagtagggcatgtgcatttaaaaacttgtccttaaaaatagaagacagaagtattaaaattatattttcttttattttaagtcttctgccttctttcttgagtttgctcctgttgacttcccacagcacagataattgacatgtccctttgtgtttataaatactactaaggtgacctagttggtctccttgttgcaataattaataactctttgcaaaatgtctcctttgagacagaggcatttcagatagatacccaccatgaggtgttctgggcatctgaaggtattaagagttcagtgggaaaaatctctctccctcgcctttttttctggtttagtcaaataacgggtgaacatagaaacctgttgggaagaatatgaaaagttatgtggcctctgaggctacaggcacttgcaaatccgagaggaaagtgccgtctttcatagctggtctctgtataaagagtatgtagcaacaactgtttaacatccgagatgaagtggacctgatgctgtatttgggtatttttctcctctaccttctaaaaaaaaataccataagaagaatcagaatgtaccataagaaatcagatgcaaagcacgttaatgtcattggtaagttttacagagtctaaaaggattagcaaagggtagcaggagcttcagggaattcaggaaatgccagcattggaattttgtggcattagttactaccttctttcttataatatgttgtagttactagtgaattcttttaaaagcaatacctagagttagaacactatgtactctgcacagggggagtgaagtaatattggcttagaagacttcaccttttgtttttcatggtttttgtttgttttgtttttgtttttgtttccattgttaccgttgctatggccctttgcctgtctctccaaatcccctggtggctcttcttatcattaagagtatgagaattaccattttcagttttcattcagcaaacaaatttaccaagtgcctgctctgcataaggcactgtgaggggtgggtgctctgggggctgctgagatgaatgacacacaccgcacatacacatgcatcagtgtctgcctgcctccccctgcccagcctgttcttcttcttcttcttcatcttcttcttttttttttttttttgtaaagacaagtttattcctttacgcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgttacacatagtttttgacttgaattaaaatactagacaaagcagaaatgtacaatttctggtctgtgttttccaggaaattcatagagaagagaatagagtggatgatgtgacttgaagtttttgcagcttattttttcccccactgtcagggcagaggcccattttaatgaatgtttttgcatgacctgttcttatgttaaccacatattttttttcccaattccacacagcaggtgatttcccgtgtgacatattttcttcatagtccctaatatagtcatcctctacagagttggcgtgctgtgtgcactgtggattaggaacagagtggagctgtaaccagtctcttctctggccctttgcctttatgtcagcttgcacttttgcctcacttattcctagtccagctcccaactgcctgacttaatggaccagaacggagatttggatattaagatgcagagggggaggggaagggatggtagagatagacagctctcccctactaggttgggtcatttcccctaataactatagagagactgtgtttcaactctcttttcattgctgtttccagaagagtggagagtgtggtttcaggcaaggtattaatgatacaattccgtggtatacagctcctgtgacatttgaagtttcttttaaaggggtttttcttaatcaaagttttacatttggtagcataagtagttctttatgcttcacaggacattgtcttcagagtaatctctctgctaaaatggtacatgtgggtcacagattggtttatgccactgacttggttaagtttccaccccctccaatttgtgaaaaacagagcagtgacctagctgttgcatcatcatgactgccatgtaacctgtaattgctgctctccagtaattgtcttttcattttgatggtaggggccagactgaatgaataatgcattcttttttattcaatttatttcattcagtttattcttggcaatcaaacatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtatttaaaaaaaaaaaaaaaaaaa

SEQ ID NO: 27331 - DNA, 5443 bp, Homo sapiens
ctctggtgacattttcttgggggcggcgcggacgactgaagggacttggtggtagaggctgcggaggcggcgaggttcactttggtcccggcaggggctctgaccgcgacccactgctcgctgccggggcttgttccgaggaggagaaggcggcggtggccgtcgcgtcctgagtcaccgcagcggggaagagtcccggccgggggttcggtgcgtgccccgacggggcgcgcgcgaagcgagcgagaaggcacggagtcgccgcggagcgcaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccagatggacctccagttgtagctcattatgatatgtctgacaccaactctgacccagaagtggtaaatgtggacaatttattggcggctgcagtagttcaagagcacagtaattctgtaggcggccaggacacaggagctacctggaggaccagcgggcttctagaggagctgaatgcagaggcaggtcatttggatccaggattcctagcaagtgacaaaacatctgctggcaatgcgccactcaatgaagaaattaacattgcgtcttcagatagtgaagtagagattgtgggagttcaggaacatgcaaggtgtgttcatcctcgaggtggtgtgattcagagtgtttcttcatggaagcatggctcgggcacgcagtatgttagcaccaggcaaacacagtcatggactgctgtgactccccagcagacttgggcttcaccagcagaagttgttgaccttaccttggatgaggatagcaggcgtaaatacctactgtaatacaatgtcactgtgtttcctctgcactgttcccttccacttcctcatcctctttgtgacatggaagttcattgtcatagcttcagcttcagaagctgtttgtggcatttgtaggattcaaactcatggaaaattccctcctcttcccccctttttttaattaaaagaagtcacttaggaaaataacatcacagagaaaagaatttcttctttccctcagtaggaatatagaatgatgaattttattagacaactttattttacttggtgacttttaatcttaggaaactctgccttccttttagaataatattttaattgccaggcaaaatgggtttcagtttttgaatcttgtatttatttttctgtataatgaaattaatatctagacttgaccactatctgcccaccccattggcactcccatcttagggcattcgcacacatatcagtcaggtccttattggcacctagtagggcatgtgcatttaaaaacttgtccttaaaaatagaagacagaagtattaaaattatattttcttttattttaagtcttctgccttctttcttgagtttgctcctgttgacttcccacagcacagataattgacatgtccctttgtgtttataaatactactaaggtgacctagttggtctccttgttgcaataattaataactctttgcaaaatgtctcctttgagacagaggcatttcagatagatacccaccatgaggtgttctgggcatctgaaggtattaagagttcagtgggaaaaatctctctccctcgcctttttttctggtttagtcaaataacgggtgaacatagaaacctgttgggaagaatatgaaaagttatgtggcctctgaggctacaggcacttgcaaatccgagaggaaagtgccgtctttcatagctggtctctgtataaagagtatgtagcaacaactgtttaacatccgagatgaagtggacctgatgctgtatttgggtatttttctcctctaccttctaaaaaaaaataccataagaagaatcagaatgtaccataagaaatcagatgcaaagcacgttaatgtcattggtaagttttacagagtctaaaaggattagcaaagggtagcaggagcttcagggaattcaggaaatgccagcattggaattttgtggcattagttactaccttctttcttataatatgttgtagttactagtgaattcttttaaaagcaatacctagagttagaacactatgtactctgcacagggggagtgaagtaatattggcttagaagacttcaccttttgtttttcatggtttttgtttgttttgtttttgtttttgtttccattgttaccgttgctatggccctttgcctgtctctccaaatcccctggtggctcttcttatcattaagagtatgagaattaccattttcagttttcattcagcaaacaaatttaccaagtgcctgctctgcataaggcactgtgaggggtgggtgctctgggggctgctgagatgaatgacacacaccgcacatacacatgcatcagtgtctgcctgcctccccctgcccagcctgttcttcttcttcttcttcatcttcttcttttttttttttttttgtaaagacaagtttattcctttacgcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgttacacatagtttttgacttgaattaaaatactagacaaagcagaaatgtacaatttctggtctgtgttttccaggaaattcatagagaagagaatagagtggatgatgtgacttgaagtttttgcagcttattttttcccccactgtcagggcagaggcccattttaatgaatgtttttgcatgacctgttcttatgttaaccacatattttttttcccaattccacacagcaggtgatttcccgtgtgacatattttcttcatagtccctaatatagtcatcctctacagagttggcgtgctgtgtgcactgtggattaggaacagagtggagctgtaaccagtctcttctctggccctttgcctttatgtcagcttgcacttttgcctcacttattcctagtccagctcccaactgcctgacttaatggaccagaacggagatttggatattaagatgcagagggggaggggaagggatggtagagatagacagctctcccctactaggttgggtcatttcccctaataactatagagagactgtgtttcaactctcttttcattgctgtttccagaagagtggagagtgtggtttcaggcaaggtattaatgatacaattccgtggtatacagctcctgtgacatttgaagtttcttttaaaggggtttttcttaatcaaagttttacatttggtagcataagtagttctttatgcttcacaggacattgtcttcagagtaatctctctgctaaaatggtacatgtgggtcacagattggtttatgccactgacttggttaagtttccaccccctccaatttgtgaaaaacagagcagtgacctagctgttgcatcatcatgactgccatgtaacctgtaattgctgctctccagtaattgtcttttcattttgatggtaggggccagactgaatgaataatgcattcttttttattcaatttatttcattcagtttattcttggcaatcaaacatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtatttaaaaaaaaaaaaaaaaaaa

SEQ ID NO: 27332 - DNA, 2228 bp, Homo sapiens
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttta

SEQ ID NO: 27333 - DNA, 2086 bp, Homo sapiens
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttta

SEQ ID NO: 27334 - DNA, 3836 bp, Homo sapiens
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 27335 - DNA, 3821 bp, Homo sapiens
ctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 27336 - DNA, 3271 bp, Homo sapiens
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcactttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 27337 - DNA, 6794 bp, Homo sapiens
ggcggcggcggcggcagagggagtttccgctttgcactccaccccggtagcagctccgcggcagggacagcttcctccggacgcttggcgggcttcgctctcgccttacgacagcccggtcggatcatggggttgcccagggggccggagggccagggtctcccggaggtggaaacaagagaagatgaagaacaaaatgtcaagttgactgaaattctggagctcttggttgcagctgggtatttcagggcaagaattaaaggcttatcaccctttgacaaggtagtaggaggaatgacttggtgtatcaccacttgcaactttgatgtagatgttgatttgctctttcaagaaaactctacgataggtcaaaaaatagctctgtcagaaaaaattgtctcggtcctgccaaggatgaaatgcccacaccagctggagccccaccagatccaggggatggattttattcacatatttcctgttgttcagtggctggtgaaacgagctatagaaacaaaagaagagatgggtgactatatccgctcctactctgtatcccagttccagaagacttacagtctccctgaggatgatgacttcataaagagaaaagaaaaggccatcaagacagttgtggacctctcagaagtgtacaagccccgtcggaaatacaaacgccaccagggagcagaggagctacttgatgaagaatctcgaatccatgctacacttttggaatatggcaggagatatggatttagccgccagagcaaaatggagaaggctgaggacaagaaaacggcacttccagcagggctgtcagctacagaaaaagctgatgcccacgaggaagatgagcttcgagcagctgaagagcagcgtattcagtcgctgatgaccaagatgaccgctatggcaaatgaggagagccgtctcaccgcaagctccgtgggccagattgtgggactctgctctgctgagatcaagcagattgtgtccgagtatgcagagaagcagtctgagctatcagctgaagaaagtccagaaaaattaggaacctcccagctacatcgccggaaagtcatttccttgaacaaacagattgcgcaaaagaccaaacatcttgaagagctgcgagcaagtcacaccagcctacaagccagatataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaactctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctgccccaatgttcatgtgagtcacagcatgcagaggggctgtgcatccccctcattgaaggcacatttgatgaggctacgctgcagatgggtcatggtctgagccaggagagagatagacactgttccctgcactcaaggcaagtagggtgtcaggaggaagagcagtagggtttgcagagatccagggaaacttcctggaggaggcagcatttgagccctatctaaagggagaatcggatgttgataggaagactgttttaaatgaaaatacactatgattaaaaacccaagagagtgcagaggagtacaaggcatgcatgttgggaaaggagggaataagctagtctctgcaggaggcttcagagacccgtctgggaagtagggctgagactaggctttggagggccttgaagggcagctgagggttgattttaatccttggaaatgaccagtgcagatcaaacatggagctcctgctgccctggtcctcaggagtctggtaactcagtcatgttctgtaggtttgtgctccattttgcataaatcttgcaaacataccaggtggcaggtttgcacagtaacacaaaagcttaaacatgtcaagcaagtggggcattcagcagccacagaaatgtgttcatttttagtccctaatggatgtgattaagcagggctgatgtgtacagatttaaaaacacacacacgtgctggattaaaaacagccactggtttcagtgccagggccagcaaggcctacctgagccaggcggaagcagcagcttgcaaatagaaactgccacctgcgagcgcttcttgggtcatgtgcagctccacctcagctggtccctgagccgtggtcatgtgggggttttgaagggctaagttgaagcaagtaattgcaaaagaacaggtggcactctgagggcaggggaaggagacagaagtttgactgcgtttgaaattatttcagtcagggaaacatctgcgttgtcttgttaagcagcttgtaggcccacccctggctaactgaactttgtgagcagttggggcagttatttgaatatttgtccaaaggtggtagggaggcagatgacattctggggttactggagtccacctctgtgctgatggggaaagtatggcatgatgaatccaaagcaaccagtaattctttttgaaagtgcaggcatttattttgagctgtatttcataggagtttcatttggtttggttttggtatagagaggtgtccatagatctctattccctttttttttttatcgacaaggcctactacggataaatcagtttttgttgcctgaatacactttgaattagactacagaagccagtttgagctcaaatttcacacttgctgcagacaactctcagtgtggacagtgcctttctgagtaattaggatgttacatgactttttggtgaagccgtatagggtaaggagatgccccaaggcccctgatcatttcagaagccacctggagcaccagaaggggtcatcttcccagggctatggctctgtgtgcttagacagacatagtatggaattgtgctctaagcccacaggcttctccggagttaaaaggaagcaagaacatccttaagttactttttcaaaatatgcgcttcaggaggaaccaggtttccccaggagagagaggctccctgctcaatcagcacagggagttgctagcgggcaggctgcccagtgctgtggaatctccgccagcctctgggttgggggctccctcccacttcttgcttcttatggagtacatgggactgctctgctttaagccgcgatcagagctgttgtgagcaggacaagattgcgtgatcacgaggtgcgtggggagatgctaggacatttgttgatgtctttgacctgtgctccgtctctgttggatgactgggttagctaacaccactagagggaggtacagaatgttaaacagtcgtcagagtcacactgagggttgttttaacagagggcaaattcccagtttgtcaagcatatctctgttagagtccgaagttcatggttttaatggttctagctcgtagcccttaatattttcaggatagctgggtcctgccagtgtccgctgagtccatcagcacaaccagaaggtccagggtccaggcatgggaagcattctctgacaataccgagccctcgggacctcctgaaaccttgagcagaggctggagaagaccttcagacagtccttttactacctcacaaagtgccatgcccgggacctcagacctcagggttgtgacgttgttgatgttgtcaggccccagtacgtctctagtgaccgaagcagacctgcctgaaagggcactccggacagtgagccctggctctaacctgtgccctcatatttctgctgcctcatatggtcttgtttgcccactctgtaggtgactgatcaccctaaaagggaggtaggtatctagcagtagcacagttactttgagcctgaccacttgttctgaagtgcagatgttgaaacatgcattgaggaagaacactttaaggaagcactttatgatttactcatggctggtgttggcctcaaagtaaaagaacatcttaatgcagaacagtacaataaagagccccataggatggatgccatcatctgtccccatggttgggattgccaaggaaagtgccttgttctgtgcatcttcagaatcccccaggccctctcttgatccttttcatgaagtccagagcattccttctattacaggctgaagatgcattgtaaaaggtaatgctataatagtattccctcttctcaataaatgtgcaaaactggagaatctggtgctgatctgcagcatacttgacaacacagggaataccgtggatgttccacgccagccttacatccgtccccattgcctgcccatgtccagtggccctgcgcaacaaaagtaagggcttgtcttaccacactctccccagcatctagctcaaggtagatgactgactgggaaattccggttggataaaatggcttttccacattgcaactttgcatctctattaggaaaatttagattgaacctttcctctacttgatgcttagtttgagaacagttttcacaactttagagggtctctctcagagtatgttatactgtaaccttgaagtttgagatgaaacaaggtgtcagaggttttgaatctttcaaaggaattgccttttacagatttttttttttattccctaagaagggaaaaagagagggaagaactacactaatgttagagataaggtatgttttggctcaaaatgtgtcatgaacctaaaggtaacttgatgggcagaaatgtctcagccatgtgaaccaagaagtgggaccacagtgcaaggctgtgggtggcagcactagatacggtggtggcaggagtgtgacatgtaggcactccatgggggacagctggacggtgtctatcaaaagtgcaaatgcataagctctttgaactagcaatgctactcctaagaattgtacctgtgtacaaggtacttgtgtacaagagtttttgttgaaacattgtaatagcaaaaagttggagagtgccaccaatacaggggaatggttaaatacattatggccagcttaaacaatggaatagtttgtagaaatttaaaacaatggatcctgtgtgtgtgtactaccatagaatgggccccaagatgcatgattaagtgaggaaaaaagcccatggtatcctaatgtttggaatggagaaagtgtgtagatgtatgtgtgtgcatatgttttcacacagacgtatacacgtgtatatcatatgtccacctgcatatgcctaggatgtctctgggaggatatctagcagcccggcagcctgaattgcctctgggaagaggggtgggaatgacttttcaatgtacaccttttgtaccttttgaattttgtaccatgtacatgtattatctattaaaaaatagttcttaatttttaa

SEQ ID NO: 27338 - DNA, 440 bp, Homo sapiens
ggcaccacacacctcccagctctgcagacgagatgcagcgactatgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcagacccgtccaagaagcagggaccatggctggaggaagaagaagaagcctatggatggatggacttcggccgccgcagtgctgaggatgagaactaacaatcctagaaccaagcttcagagcctagccacctcccaccccactccagccctgtcccctgaaaaactgatcaaaaataaactagtttccagtggaaaaaa

SEQ ID NO: 27339 - DNA, 2685 bp, Homo sapiens
ggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtcctttttta

SEQ ID NO: 27340 - DNA, 1617 bp, Homo sapiens
aaaaaaaaaaaccttcctcccgtcttgccttctccctcgagttgggacccgggaagaaccatgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacaccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtct

SEQ ID NO: 27341 - DNA, 1910 bp, Homo sapiens
ttttttctccctctctattcagctgtctccatcccccttttccgcctctctctctgcctttttgggaggcagccctgcagacatggttaaaactcgggcccagcctgactgtggttcccagctccagccctagtcagcttaacttctttgcattatggggcagaagtgggagcttctcccttccttccatcttcctctcttagatcagctggttaagagtccagcctgggtttggctcccagctccagcactagtcaacttaacttctttgcattgttgggcagaagagggggcgtctcctttccttccttcttcctctcttagaccagcttcccttcccttctggggctgccacagcacccggtcagcagaatccttgcctaattcctcttccttctccaaaccacagggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacaccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtct

SEQ ID NO: 27342 - DNA, 3123 bp, Homo sapiens
atgaacgggcagcatccaggcctgggccccagatcccatttccttatggattcatagccaatcagctttccagaatccccccaggaacagctggcacaggggaacacactccagggggaaggtggaagttggccaagccagagacccctagaaagacacctccctgcaggaggagggaagagctgtctaggaagccaagactctgcaagggtgagatagccactgtcctcctagtcacggaggcaggaccatccaccagcatccctggggagagctgggggacccacctgtccacgcatctgacaatttaaggggccggtgaaccagcacacgctcctgccactcgaggaaacatgtcactttccgtctagaagtggggcaaaatggctaagaaattgtgtgaagtcacttcattccaccctccccttcagggcctccccggtctcccttgcagcttcatttccacgctcttcttccccagctagcctgctagcgtgctcagtggtgtgggttttcccaagaatgaacaatttcccaggacagagactttcagtactaaaactgggaccagcccaggcaaaccaggacacatggatcacctcatgtctgcccagccatgctagaatttcaccagttcctccaacacctgccccagccctctggtctctgtacctccccgcataccatcccctgatgatgtcctccttctctcttcacctgcctggcattccagggtgtctgttcccctggctgctcccctccaccacctctcaccctggaccctgtttttgttccctgcctcatgcctgactgatcatcttgcccttctgccaacataacttatcttgccagctaggcagggagctccctgcagcctggaactgtgaggctgtcttgtttcacttggcatttcccatgcctggcagagagtaggcacttgggaaatatttgttgggcaaatgaatgcgggacgaatgagtgcgtgaacgagaggaacagaaatttcacgcattggccaatggatgggtggggaagaaatgtctgggctcacctcctagttcctccttggagagaagtacccctgagagctcagggagcttaacttgcttcttgccctcagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacgtgagtccagccccgactgctctgttctacactcaagtagtgggtgtgccaggcagaagggacagaaacccttctaacttttctcaccctcactctttccagatggtggtcagctgctcagccatcagcagcctgcccgacatcgtcttcaccatcaatggagtccagtaccccgtgccacccagtgcctacatcctgcaggtgaggaggctctggaccatccactagaggggttcacacagaatgtggacacagagttcccctctgcagacggaaagtacacttccacgagctgaagccaagaggcagaggcagacgaacatctgccctagacagcctccagagaaaaagaatatattaaaaacaaatgcaggaataagaactcggatacagccccctaagggaacaagtgaagcaaaggttaatggagtgaaaagaggattctatttggacccctgggtccaagtcctgggtctgaattactagcccattgattctgaacaaattacaactcatctcaccctcagttttctcatccaaaaagtagagatggcagctttccccaccctcagagtgcggttaggtcaaccaagtgagactgatcacatcagagctaccaagggttgggcaaatggaaatcctaatttccgtaggctggggcttctgacacttctaccatctctaccaagtagcaaatctttagctatacgagccacaagaaaactctttcccttctgttatcataacgtcaggtggaaaactaattttgccagtggactcatgttactcaacaagaagcactgatgcctgggctcccccactgattctgattacattaggagagggcaaggcctgagcaatgggatggggctgcgggggttcaaagctccccaggtgatgtgcagacaaggtcgcagcccagtgacttagtgaggcaagagggctaatagctcatctggtttgcctctgaccggatcagaataataatgagaaaaggctatggcggcagggttttcaaactccttcctagcagctgaattctccctaagccccttagcaccaatgctgatgtcagggttcgtgtgcctgccagaaacaccagataatgtccagtaatgcgtagaaaccagtcgttcagtggacggcttctacaggccgactccaggccaagaacagccgagtccctggacactgagccaggaagctcctccttgcacgtgccttacagctggaccagggcgccctggatgtttatcacccagcgcctatcacggctgaatcggtgtcccagctccacttttattctccttttctccagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacaccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtct

SEQ ID NO: 27343 - DNA, 870 bp, Homo sapiens
gaaatgtctgggctcacctcctagttcctccttggagagaagtacccctgagagctcagggagcttaacttgcttcttgccctcagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacaccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtct

SEQ ID NO: 27344 - DNA, 1617 bp, Homo sapiens
aaacaaaaaaaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtct

SEQ ID NO: 27345 - DNA, 1910 bp, Homo sapiens
ttttttttctctctctcttcagctgtctccatcccccttttccgcctctctctctgcctttttgggaggcagccctgcagacatggttaaaactcgggcccagcctgactgtggttcccagctccagccctagtcagcttaacttctttgcattatggggcagaagtgggagcttctcccttccttccatcttcctctcttagatcagctggttaagagtccagcctgggtttggctcccagctccagcactagtcaacttaacttctttgcattgttgggcagaagagggggcgtctcctttccttccttcttcctctcttagaccagcttcccttcccttctggggctgccacagcacccggtcagcagaatccttgcctaattcctcttccttctccaaaccacagggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtct

SEQ ID NO: 27346 - DNA, 3123 bp, Homo sapiens
atgaacgggcagcatccaggcctgggccccagatcccatttccttatggattcatagccaatcagctttccagaatccccccaggaacagctggcacaggggaacacactccagggggaaggtggaagttggccaagccagagacccctagaaagacacctccctgcaggaggagggaagagctgtctaggaagccaagactctgcaagggtgagatagccactgtcctcctagtcacggaggcaggaccatccaccagcatccctggggagagctgggggacccacctgtccacgcatctgacaatttaaggggccggtgaaccagcacacgctcctgccactcgaggaaacatgtcactttccgtctagaagtggggcaaaatggctaagaaattgtgtgaagtcacttcattccaccctccccttcagggcctccccggtctcccttgcagcttcatttccacgctcttcttccccagctagcctgctagcgtgctcagtggtgtgggttttcccaagaatgaacaatttcccaggacagagactttcagtactaaaactgggaccagcccaggcaaaccaggacacatggatcacctcatgtctgcccagccatgctagaatttcaccagttcctccaacacctgccccagccctctggtctctgtacctccccgcataccatcccctgatgatgtcctccttctctcttcacctgcctggcattccagggtgtctgttcccctggctgctcccctccaccacctctcaccctggaccctgtttttgttccctgcctcatgcctgactgatcatcttgcccttctgccaacataacttatcttgccagctaggcagggagctccctgcagcctggaactgtgaggctgtcttgtttcacttggcatttcccatgcctggcagagagtaggcacttgggaaatatttgttgggcaaatgaatgcgggacgaatgagtgcgtgaacgagaggaacagaaatttcacgcattggccaatggatgggtggggaagaaatgtctgggctcacctcctagttcctccttggagagaagtacccctgagagctcagggagcttaacttgcttcttgccctcagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacgtgagtccagccccgactgctctgttctacactcaagtagtgggtgtgccaggcagaagggacagaaacccttctaacttttctcaccctcactctttccagatggtggtcagctgctcagccatcagcagcctgcccgacatcgtcttcaccatcaatggagtccagtaccccgtgccacccagtgcctacatcctgcaggtgaggaggctctggaccatccactagaggggttcacacagaatgtggacacagagttcccctctgcagacggaaagtacacttccacgagctgaagccagcaggcagaggcagacgaacatctgccctagacagcctccagagaaaaagaatatattaaaaacaaatgcaggaataagaactcggatacagccccctaagggaacaagtgaagcaaaggttaatggagtgaaaagaggattctatttggacccctgggtccaagtcctgggtctgaattactagcccattgattctgagcaagctacagctcatctcaccctcagttttctcatccaaaaagtagagatggcagctttccccaccctcagagtgcggttaggtcaaccaagtgagactgatcacatcagagctaccaagggttgggcaaatggaaatcctaatttccataggctggggcttctgacacttctaccatctctaccaagtagcaaatctttagctatacgagccacaagaaaactctttcccttctgttatcataacgtcaggtggaaaactaattttgccagtggactcatgttactcaacaagaagcactgatgcctgggctcccccactgattctgattacattaggagagggcaaggcctgagcaatgggatggggctgcgggggttcaaagctccccaggtgatgtgcagacaaggtcgcagcccagtgacttagtgaggcaagagggctaatagctcatctggtttgcctctgaccggatcagaataataatgagaaaaggctatggcggcagggttttcaaactccttcctagcagctgaattctccctaagccccttagcaccaatgctgatgtcagggttcgtgtgcctgccagaaacaccagataatgtccagtaatgcgtagaaaccagtcgttcagtggacggcttctacaggccgactccaggccaagaacagccgagtccctggacactgagccaggaagctcctccttgcacgtgccttacagctggaccagggcgccctggatgtttatcacccagcgcctatcacggctgaatcggtgtcccagctccacttttattctccttttctccagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtct

SEQ ID NO: 27347 - DNA, 870 bp, Homo sapiens
gaaatgtctgggctcacctcctagttcctccttggagagaagtacccctgagagctcagggagcttaacttgcttcttgccctcagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtct

SEQ ID NO: 27348 - DNA, 939 bp, Homo sapiens
gcgccaactccggcgtcgggaacactcaccgcaggacgctttgccctccttggaatcgcagtagccgcagtggtagccggccctgaggcccttgtattccaccaccgacgccatggccgccgcgagggtccgctcgggccgaccacgcctcttggcgcccggggccgacctcggcgaagcgctggggcccgcggcgggaggggtggagagcgaagcctggcgcggggacccgtgggcggggatggtggtcgtgtccccaagccctgcgtttgggccggtgcttcccacagctgtgcgttatcagccccatttcacagtttgctaaagcagaggcgtactactatcaatagcatcaagaaatgatgatggaagaagcatggaaatacaatatggttccaaaatgggaaactaaaatagaggaagaggaaaagagatcacaacgtgagaaaacagaagatactaaaaaatgggactatctagtgcctgagagggaactgagtcttacaaagaaacatataccaggctgaacaaaccagaggcctcagagaccacaaacaccgactgctccctcaaagaattcccagtgaaatactttcccctaaaatactaacacgggaaaaggatggaaagcatgaaaatatccagaaaacacacaaaactgaaaccagtaagcacaaggtggcatggacaaaggaacagatgaagggacaccaagaccgaatgatctgagggagagaactcaaagcaaagacacgctcagaagcgctccagccccgttccatctttcctaaaatctcaagtggaaaaagagaaggtgaaagagtttgaatgggtcacagcttatccaattttgcaaccttaccagaaagcacttaggaaagtgatgattctgatggagaaataagaaaaaagagagtataaaattaagaaaccactctg

SEQ ID NO: 27349 - DNA, 939 bp, Homo sapiens; identical to SEQ ID NO: 27348

SEQ ID NO: 27350 - DNA, 1973 bp, Homo sapiens
gggatattggagtagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgtttt

SEQ ID NO: 27351 - DNA, 1387 bp, Homo sapiens
tctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacagcatcaccatgaacggagagaccatcgcctgtgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacgtccccaccgaatctggagagctttggatcctgggtgatgtcttcatccgccagtactttaccgtcttcgacagggcaaacaaccaggtcggcctggcccctgtggcttaagcctaagtctcttcagccacctcccaggaagatctggcctccgtcctatgcccactttagatgtatctaattctcctgactgttcttcccaggggagtgtgaaggtcttggccctgttccctgtcctaccaataacgtagaataaaaacataacccactgaaaaaaaaaaaaaaaaaaaaaaaaaaaaaa

SEQ ID NO: 27352 - DNA, 1366 bp, Homo sapiens
cgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaaccagcagggctccagcgggggagcggttgtctttgggggtgtggatagcagcctgtacacggggcagatctactgggcgcctgtcacccaggaactctactggcagattggcattgaagagttcctcatcggcggccaggcctccggctggtgttctgagggttgccaggccatcgtggacacaggcacctctctgctaactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttctaaaaaaaaaaa

SEQ ID NO: 27353 - DNA, 9736 bp, Homo sapiens
caaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaagagtatttgatttctgacactggaggacaacagctctcaataagtgacgctttcatcaaagaatccttatttaatcgccgagtagaggaaaaatccaaagagctgcctttcacacctttgggctggcatcataacaacctggagctcctgagggaggagaatggggagaaacaagccatggagaggttgctttcagctaatcataaccacatgatggcactactccagcagttgctccatagtgactcactgtcatcatcttggagggacatcatcgtgtcattggtctgccaggttgttcagacagtccgacctgatgtcaagaaccaggatgatgacatggatatccgtcagtttgtccacatcaaaaaaatcccaggtggaaagaagtttgattctgtggttgtcaatggctttgtttgtaccaagaacattgcacataaaaagatgaattcttgtattaaaaaccctaaaattcttctgttgaagtgttccattgagtatctctacagagaagaaactaagtttacttgcattgatcctattgtgcttcaggaaagggaattcttgaagaattatgtccagcgaatagttgatgttcgacccaccttggttcttgttgagaaaacagtgtctcggattgcccaggacatgttattggaacatggcattactttggtcattaatgtaaagtcacaagttttggaacgaatcagtcgaatgacccaaggtgatttagtgatgtcaatggaccagctgcttacgaaaccacacctgggcacttgtcacaaattttatatgcagatatttcagttgcctaatgaacaaaccaagacactgatgttttttgaaggttgtccacagcacctaggctgtacaatcaagctaagaggaggctctgattatgagctggctcgagttaaggagatcctaatatttatgatctgtgttgcttatcattctcaactagaaatatcctttctcatggatgaatttgctatgcctcccacattaatgcaaaacccttcattccattccctgattgagggacgagggcatgagggggctgtccaagagcagtacggtggaggttccatcccctgggatcctgacatccctcctgagtctctgccctgtgatgatagcagtttgctggaatcgaggattgtgtttgagaagggtgagcaggaaaataaaaatcttccgcaggctgttgcctctgtgaagcatcaagaacatagcacaacagcttgcccggcgggtctcccttgtgctttctttgcacctgtaccggaatcattgttgccactccctgtggatgaccaacaagatgctttaggcagcgagctgccagagagtttgcagcaaacagttgtgctgcaggatcccaaaagccagataagagcctttagagaccctctacaggatgacactggattatatgttactgaggaagtcacctcctctgaagataaacgaaagacttattctttggcctttaagcaggaattaaaagatgtgatcctctgtatctccccagtaatcacattccgagaaccctttcttttaactgaaaaggggatgagatgctctacccgagattattttgcagagcaggtttactggtctcctctcctcaataaagaattcaaagaaatggagaacaggaggaagaaacagctgctcagggatctctctggacttcagggcatgaatggaagtattcaggccaagtctattcaagtcttaccctcacatgagctagtgagcactagaattgctgagcatctgggcgatagccagagcttgggtagaatgctggccgattatcgagccagaggaggaagaattcagcccaaaaattcagacccttttgctcattcaaaggatgcatcaagtacttcaagtggcaaatcaggaagcaaaaatgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatttgcaaaataccttgaacttaggttttatgggcaccagtatactcgcagagccaacgctgagccctgtggtcactccatccatcatgattatcaccagtatttctcctataaccagatggtggcgtctttcagttattctcccattcggcttcttgaagtatgtgttccactccccaaaatattcattaagcgtcaggccccattaaaagtgtcccttcttcaggatctgaaggacttctttcaaaaagtttcacaggtatatgttgccattgatgaaagacttgcatctttgaaaactgatacatttagtaaaacaagagaggaaaaaatggaagatatttttgcacagaaagagatggaagaaggtgagttcaagaactggattgagaagatgcaagcaaggctcatgtcttcctctgtagatacccctcagcaactgcagtcggtctttgagtcactcattgccaagaaacaaagtctctgtgaagtgctgcaagcttggaataacaggttgcaggaccttttccaacaggaaaagggtagaaagagaccttcagttcctccaagtcctggaagactgagacaaggggaagaaagcaagataagtgcgatggatgcatctccacggaatatttctccaggacttcagaatggagaaaaagaggatcgcttcttaacaactttgtccagccagagctccaccagttctactcatctccaattgcctacgccacctgaagtcatgtctgaacagtcagtgggagggccccctgagctagatacagccagcagttccgaagatgtgtttgatgggcatttgctgggatccacagacagccaagtgaaggaaaagtcaaccatgaaagccatctttgcaaatttgcttccaggaaatagctataatcctattccatttccttttgatccagataaacactacttaatgtatgaacatgaacgagtgcccattgcagtctgcgagaaggaacccagctccatcattgcttttgctctcagttgtaaagaataccgaaatgccttagaggaattgtctaaagcgactcagtggaacagtgccgaagaagggcttccaacaaatagtacttcagatagcagaccaaagagtagcagccctatcagattacctgaaatgagtggaggacagacaaatcgtacaacagaaacagaaccacaaccaaccaaaaaggcttctggaatgttgtccttcttcagagggacagcagggaaaagccccgatctctcttcccagaagagagagaccttacgtggagcagatagtgcttactaccaggttgggcagacgggcaaggaggggaccgagaatcaaggcgttgagcctcaagatgaagtagatggaggagatacacaaaagaagcaactcataaatcctcatgtggaacttcaattttcagatgctaatgccaagttttactgtcggctctactatgcgggagagtttcataagatgcgtgaagtgattctggacagcagtgaagaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtgtctgtttagactgtccgtaatggaatggtaaaactccatgaatttgcactttggtttttgatacctgtggagctgtctgtacgttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccagttaaacacgtgggcatttattgttttattgaggaatttgacttaaactgggaatcctgtcatgttgtttatctttccagcttgcctgtttttgagtatgtttgatgtttttaaaattttgtcttctctgtggatgacaggaggctacagcaattaactttaagcctccttttagagatatttttaaagcttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgaggaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttattttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactccaaaa

SEQ ID NO: 27354 - DNA, 9908 bp, Homo sapiens
caaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggatagtgacctgaaacaatactggatgccagatagccaatgtaaagagtgctatgactgtagtgagaaatttacaacctttaggcgcagacaccattgccgactatgtgggcagattttctgcagtcgttgctgtaatcaagaaatccctggaaaatttatgggctatacaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaagagtatttgatttctgacactggaggacaacagctctcaataagtgacgctttcatcaaagaatccttatttaatcgccgagtagaggaaaaatccaaagagctgcctttcacacctttgggctggcatcataacaacctggagctcctgagggaggagaatggggagaaacaagccatggagaggttgctttcagctaatcataaccacatgatggcactactccagcagttgctccatagtgactcactgtcatcatcttggagggacatcatcgtgtcattggtctgccaggttgttcagacagtccgacctgatgtcaagaaccaggatgatgacatggatatccgtcagtttgtccacatcaaaaaaatcccaggtggaaagaagtttgattctgtggttgtcaatggctttgtttgtaccaagaacattgcacataaaaagatgaattcttgtattaaaaaccctaaaattcttctgttgaagtgttccattgagtatctctacagagaagaaactaagtttacttgcattgatcctattgtgcttcaggaaagggaattcttgaagaattatgtccagcgaatagttgatgttcgacccaccttggttcttgttgagaaaacagtgtctcggattgcccaggacatgttattggaacatggcattactttggtcattaatgtaaagtcacaagttttggaacgaatcagtcgaatgacccaaggtgatttagtgatgtcaatggaccagctgcttacgaaaccacacctgggcacttgtcacaaattttatatgcagatatttcagttgcctaatgaacaaaccaagacactgatgttttttgaaggttgtccacagcacctaggctgtacaatcaagctaagaggaggctctgattatgagctggctcgagttaaggagatcctaatatttatgatctgtgttgcttatcattctcaactagaaatatcctttctcatggatgaatttgctatgcctcccacattaatgcaaaacccttcattccattccctgattgagggacgagggcatgagggggctgtccaagagcagtacggtggaggttccatcccctgggatcctgacatccctcctgagtctctgccctgtgatgatagcagtttgctggaatcgaggattgtgtttgagaagggtgagcaggaaaataaaaatcttccgcaggctgttgcctctgtgaagcatcaagaacatagcacaacagcttgcccggcgggtctcccttgtgctttctttgcacctgtaccggaatcattgttgccactccctgtggatgaccaacaagatgctttaggcagcgagctgccagagagtttgcagcaaacagttgtgctgcaggatcccaaaagccagataagagcctttagagaccctctacaggatgacactggattatatgttactgaggaagtcacctcctctgaagataaacgaaagacttattctttggcctttaagcaggaattaaaagatgtgatcctctgtatctccccagtaatcacattccgagaaccctttcttttaactgaaaaggggatgagatgctctacccgagattattttgcagagcaggtttactggtctcctctcctcaataaagaattcaaagaaatggagaacaggaggaagaaacagctgctcagggatctctctggacttcagggcatgaatggaagtattcaggccaagtctattcaagtcttaccctcacatgagctagtgagcactagaattgctgagcatctgggcgatagccagagcttgggtagaatgctggccgattatcgagccagaggaggaagaattcagcccaaaaattcagacccttttgctcattcaaaggatgcatcaagtacttcaagtggcaaatcaggaagcaaaaatgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatttgcaaaataccttgaacttaggttttatgggcaccagtatactcgcagagccaacgctgagccctgtggtcactccatccatcatgattatcaccagtatttctcctataaccagatggtggcgtctttcagttattctcccattcggcttcttgaagtatgtgttccactccccaaaatattcattaagcgtcaggccccattaaaagtgtcccttcttcaggatctgaaggacttctttcaaaaagtttcacaggtatatgttgccattgatgaaagacttgcatctttgaaaactgatacatttagtaaaacaagagaggaaaaaatggaagatatttttgcacagaaagagatggaagaaggtgagttcaagaactggattgagaagatgcaagcaaggctcatgtcttcctctgtagatacccctcagcaactgcagtcggtctttgagtcactcattgccaagaaacaaagtctctgtgaagtgctgcaagcttggaataacaggttgcaggaccttttccaacaggaaaagggtagaaagagaccttcagttcctccaagtcctggaagactgagacaaggggaagaaagcaagataagtgcgatggatgcatctccacggaatatttctccaggacttcagaatggagaaaaagaggatcgcttcttaacaactttgtccagccagagctccaccagttctactcatctccaattgcctacgccacctgaagtcatgtctgaacagtcagtgggagggccccctgagctagatacagccagcagttccgaagatgtgtttgatgggcatttgctgggatccacagacagccaagtgaaggaaaagtcaaccatgaaagccatctttgcaaatttgcttccaggaaatagctataatcctattccatttccttttgatccagataaacactacttaatgtatgaacatgaacgagtgcccattgcagtctgcgagaaggaacccagctccatcattgcttttgctctcagttgtaaagaataccgaaatgccttagaggaattgtctaaagcgactcagtggaacagtgccgaagaagggcttccaacaaatagtacttcagatagcagaccaaagagtagcagccctatcagattacctgaaatgagtggaggacagacaaatcgtacaacagaaacagaaccacaaccaaccaaaaaggcttctggaatgttgtccttcttcagagggacagcagggaaaagccccgatctctcttcccagaagagagagaccttacgtggagcagatagtgcttactaccaggttgggcagacgggcaaggaggggaccgagaatcaaggcgttgagcctcaagatgaagtagatggaggagatacacaaaagaagcaactcataaatcctcatgtggaacttcaattttcagatgctaatgccaagttttactgtcggctctactatgcgggagagtttcataagatgcgtgaagtgattctggacagcagtgaagaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtgtctgtttagactgtccgtaatggaatggtaaaactccatgaatttgcactttggtttttgatacctgtggagctgtctgtacgttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccagttaaacacgtgggcatttattgttttattgaggaatttgacttaaactgggaatcctgtcatgttgtttatctttccagcttgcctgtttttgagtatgtttgatgtttttaaaattttgtcttctctgtggatgacaggaggctacagcaattaactttaagcctccttttagagatatttttaaagcttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgaggaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttattttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactccaaaa

SEQ ID NO: 27355 - DNA, 5915 bp, Homo sapiens
cgaagatggcggaagggctggagcgtgtgcggatctccgcgtcggagctgcgcgggatcctggctactctggccccgcaggccgggagcagagaaaacatgaaggaattaaaggaggccaggccgcgcaaagataacaggcgtcctgatctggaaatctataagcctggcctttctcggctaaggaacaagcccaaaatcaaggaaccccctgggagtgaggagttcaaagatgaaattgttaatgaccgagattgctctgctgttgaaaatggtacacagcccgttaaagatgtctgcaaggaactgaacaaccaagagcagaatggtcctatagacccggaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggccgagatagaaaagagcccaggtggtgggagagtaggggctgcaaaaggagaaaaaggaaagaggatgggaaaaggggagggggtgagggaaacccacgacgacccggcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaccagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaaggggtctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctgcctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggccccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcctcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacat

SEQ ID NO: 27356 - DNA, 616 bp, Homo sapiens
atgcattctgcaagccaccctggggtgcagctgagctagacatgggacggcgagacgcccagctcctggcagcgctcctcgtcctggggctatgtgccctggcggggagtgagaaaccctccccctgccagtgctccaggctgagcccccataacaggacgaactgcggcttccctggaatcaccagtgaccagtgttttgacaatggatgctgtttcgactccagtgtcactggggtcccctggtgtttccaccccctcccaaagcaagagtcggatcagtgcgtcatggaggtctcagaccgaagaaactgtggctacccgggcatcagccccgaggaatgcgcctctcggaagtgctgcttctccaacttcatctttgaagtgccctggtgcttcttcccgaagtctgtggaagactgccattactaagagaggctggttccagaggatgcatctggctcaccgggtgttccgaaaccaaagaagaaacttcgccttatcagcttcatacttcatgaaatcctgggttttcttaaccatcttttcctcattttcaatggtttaacatataatttctttaaataaaacccttaaaatctgctaaaaaaaaaaaa

SEQ ID NO: 27357 - DNA, 3258 bp, Homo sapiens
gcgggcggaggcggggcgcggagaagtggcggaggtggaagcggaggcgtacccgcccctggggacgtcattggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccatcaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattagccaggcgtggtggcacgtgcctgtaatcccagctacttgggaggctgaggcaggagaatcacttgaacctaggaggcggaggttgcagtgagctgagatcatgccactgcacgcaagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcatttatgtaatatgtgtcttcactggggaatactgacttcctaaaatctcaagatggaagatataccacatgtaaattattttagagcaattaaattgttttcaggattttccaaaaaaaaaaaaa

SEQ ID NO: 27358 - DNA, 2090 bp, Homo sapiens
ttcggcacgagtaagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaatgatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatacattaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaacaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttattttccagggatttaatacgtactttagttggaattattctatgtcaatgatttttaagctatgaaaaatacaatggggggaaggatagcatttggagatatacctaatgttaaatgacgagttactggatgcagcacgcaacatggcacatgtgtatacatatgtagctaacccttcgttgtgcacatgtaccctaaaacttaaagtataatttaaaaaaagcaaaaaaaaaaaataccaactcttttttttaaaccaggaaggaaaatgtgaacatggaaacaacttctagtattggatctgaaaataaagtgtcatccaagccataaaaaaaaa

SEQ ID NO: 27359 - DNA, 3145 bp, Homo sapiens
aaagtctatacgcaataagtaagcccaaagaggcatgtttgcttggcgatgcccagcagataagccaggcaaacctcggtgtgatcgaagaagccaatttgagactcagcctagtccaggcaagctactggcacctgctgctctcaactaacctccacacaatggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcataggctggtggcctaagtacagcattaatcattaaggaacccattactgccatttggaattcaaataacctaaccaacctccacctcctccttccattttgaccaaccttcttctaacaaggtgctcattcctactatgaatccagaataaacacgccaagatagcagctaaatcagcaagggttcctgtattaccaatatagaatactaacaattttactaacacgtaagcataacaaatgacagggcaagtgatttctaacttagttgagttttgcaacagtacctgtgttgttatttcagaaaatattatttctctctttttaactactctttttttttattttggacagagtcttgctccgtcgcgcaggctgtgatcgtagtggtgcgatctcggctcactgcggcctccgctccctgggttcaagcgattctcctgcctgagcctcctgagtagctgggactgcaggcacgtgccaccacgcccggctagttttttgtatttttagtagagatggggtttcacgttgttggccaggatggtctccatctcctgacctcatgatccgcccaccttggcctcccaaaatgctgggattacaggcatgagccactgcgcccggcctctttttagctactcttatgttccacatgcacatatgacaaggtggcattaattagattcaatattatttctaggaatagttcctcattcatttttatattgaccactaagaaaataattcatcagcattatctcatagattggaaaattttctccaaatacaatagaggagaatatgtaaagggtatacattaattggtacgtagcatttaaaatcaggtcttataattaatgcttcattcctcatattagatttcccaagaaatcaccctggtatccaatatctgagcatggcaaatttaaaaaataacacaatttcttgcctgtaaccctagcactttgggaggccgaggcaggtggatcacctgaggtcaggagttcgagaccagcctggccggcatggcgaaaccccttctctgctgaaaatacagaaattagctgggcgtggtggtgcatgcctgtagtcccagctacttgggaggctgaggcgggagaatcgcttgaacccagggggtggaggttgcagtgagccgagattgtgccactgcactccaacctgggtgacagagtgagattccatctgaaaaacaaaaacaaaaacagaaaacaaacaaacaaaaaacaaaaaatccccacaactttgtcaaataatgtacaggcaaacactttcaaatataatttccttcagtgaatacaaaatgttgatatcataggtgatgtacaatttagttttgaatgagttattatgttatcactgtgtctgatgttatctactttgaaaggcagtccagaaaagtgttctaagtgaactcttaagatctattttagataatttcaactaattaaataacctgttttactgcctgtacattccacattaataaagcgataccaatcttatatgaatgctaatattactaaaatgcactgatatcacttcttcttcccctgttgaaaagctttctcatgatcatatttcacccacatctcaccttgaagaaacttacaggtagacttaccttttcacttgtggaattaatcatatttaaatcttactttaaggctcaataaataatactcataatgtctcattttagtgactcctaaggctagtccttttataaacaactttttctgacatagcatttatgtataataaaccagacatttaaagtgtaaaaaaaaaaaaaaaaaa

SEQ ID NO: 27360 - protein, 343 aa, Homo sapiens
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSESETSTMAAKKNRQSSDKQNGRVAKVKGHRSQKHKERIRLLRQKREAAARKKYNLLQDSSTSDSDLTCDSSTSSSDDDEEVSGSSKTITAEIPGHLDPGFLASDKTSAGNAPLNEEINIASSDSEVEIVGVQEHARCVHPRGGVIQSVSSWKHGSGTQYVSTRQTQSWTAVTPQQTWASPAEVVDLTLDEDSRRKYLL

SEQ ID NO: 27361 - protein, 404 aa, Homo sapiens
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSESETSTMAAKKNRQSSDKQNGRVAKVKGHRSQKHKERIRLLRQKREAAARKKYNLLQDSSTSDSDLTCDSSTSSSDDDEEVSGSSKTITAEIPDGPPVVAHYDMSDTNSDPEVVNVDNLLAAAVVQEHSNSVGGQDTGATWRTSGLLEELNAEAGHLDPGFLASDKTSAGNAPLNEEINIASSDSEVEIVGVQEHARCVHPRGGVIQSVSSWKHGSGTQYVSTRQTQSWTAVTPQQTWASPAEVVDLTLDEDSRRKYLL

SEQ ID NO: 27362 - protein, 396 aa, Homo sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 27363 - protein, 363 aa, Homo sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 27364 - protein, 579 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 27365 - protein, 579 aa, Homo sapiens; identical to SEQ ID NO: 27364

SEQ ID NO: 27366 - protein, 390 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 27367 - protein, 631 aa, Homo sapiens
MGLPRGPEGQGLPEVETREDEEQNVKLTEILELLVAAGYFRARIKGLSPFDKVVGGMTWCITTCNFDVDVDLLFQENSTIGQKIALSEKIVSVLPRMKCPHQLEPHQIQGMDFIHIFPVVQWLVKRAIETKEEMGDYIRSYSVSQFQKTYSLPEDDDFIKRKEKAIKTVVDLSEVYKPRRKYKRHQGAEELLDEESRIHATLLEYGRRYGFSRQSKMEKAEDKKTALPAGLSATEKADAHEEDELRAAEEQRIQSLMTKMTAMANEESRLTASSVGQIVGLCSAEIKQIVSEYAEKQSELSAEESPEKLGTSQLHRRKVISLNKQIAQKTKHLEELRASHTSLQARYNEAKKTLTELKTYSEKLDKEQAALEKIESKADPSILQNLRALVAMNENLKSQEQEFKAHCREEMTRLQQEIENLKAERAPRGDEKTLSSGEPPGTLTSAMTHDEDLDRRYNMEKEKLYKIRLLQARRNREIAILHRKIDEVPSRAELIQYQKRFIELYRQISAVHKETKQFFTLYNTLDDKKVYLEKEISLLNSIHENFSQAMASPAARDQFLRQMEQIVEGIKQSRMKMEKKKQENKMRRDQLNDQYLELLEKQRLYFKTVKEFKEEGRKNEMLLSKVKAKAS

SEQ ID NO: 27368 - protein, 101 aa, Homo sapiens
MQRLCVYVLIFALALAAFSEASWKPRSQQPDAPLGTGANRDLELPWLEQQGPASHHRRQLGPQGPPHLVADPSKKQGPWLEEEEEAYGWMDFGRRSAEDEN

SEQ ID NO: 27369 - protein, 443 aa, Homo sapiens
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 27370 - protein, 388 aa, Homo sapiens
MKWLLLLGLVALSECIMYKVPLIRKKSLRRTLSERGLLKDFLKKHNLNPARKYFPQWKAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 27371 - protein, 315 aa, Homo sapiens
MEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 27372 - protein, 121 aa, Homo sapiens [sequence omitted]

SEQ ID NO: 27373 - protein, 128 aa, Homo sapiens
MNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 27374 - protein, 388 aa, Homo sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 27375 - protein, 315 aa, Homo sapiens; identical to SEQ ID NO: 27371

SEQ ID NO: 27376 - protein, 121 aa, Homo sapiens [sequence omitted]

SEQ ID NO: 27377 - protein, 128 aa, Homo sapiens; identical to SEQ ID NO: 27373

SEQ ID NO: 27378 - protein, 70 aa, Homo sapiens
MAAARVRSGRPRLLAPGADLGEALGPAAGGVESEAWRGDPWAGMVVVSPSPAFGPVLPTAVRYQPHFTVC

SEQ ID NO: 27379 - protein, 70 aa, Homo sapiens; identical to SEQ ID NO: 27378

SEQ ID NO: 27380 - protein, 469 aa, Homo sapiens
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 27381 - protein, 388 aa, Homo sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTINGVQYPVPPSAYILQSEGSCISGFQGMNVPTESGELWILGDVFIRQYFTVFDRANNQVGLAPVA

SEQ ID NO: 27382 - protein, 388 aa, Homo sapiens
MKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNQQGSSGGAVVFGGVDSSLYTGQIYWAPVTQELYWQIGIEEFLIGGQASGWCSEGCQAIVDTGTSLLTVPQQYMSALLQATGAQEDEYGQFLVNCNSIQNLPSLTFIINGVEFPLPPSSYILSNNGYCTVGVEPTYLSSQNGQPLWILGDVFLRSYYSVYDLGNNRVGFATAA

SEQ ID NO: 27383 - protein, 1779 aa, Homo sapiens
MVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLANSASPSKRTSVSSFQSTVDSDSAASISLNVELDNVNFHIKKPSKYPHVPPHPADQKEYLISDTGGQQLSISDAFIKESLFNRRVEEKSKELPFTPLGWHHNNLELLREENGEKQAMERLLSANHNHMMALLQQLLHSDSLSSSWRDIIVSLVCQVVQTVRPDVKNQDDDMDIRQFVHIKKIPGGKKFDSVVVNGFVCTKNIAHKKMNSCIKNPKILLLKCSIEYLYREETKFTCIDPIVLQEREFLKNYVQRIVDVRPTLVLVEKTVSRIAQDMLLEHGITLVINVKSQVLERISRMTQGDLVMSMDQLLTKPHLGTCHKFYMQIFQLPNEQTKTLMFFEGCPQHLGCTIKLRGGSDYELARVKEILIFMICVAYHSQLEISFLMDEFAMPPTLMQNPSFHSLIEGRGHEGAVQEQYGGGSIPWDPDIPPESLPCDDSSLLESRIVFEKGEQENKNLPQAVASVKHQEHSTTACPAGLPCAFFAPVPESLLPLPVDDQQDALGSELPESLQQTVVLQDPKSQIRAFRDPLQDDTGLYVTEEVTSSEDKRKTYSLAFKQELKDVILCISPVITFREPFLLTEKGMRCSTRDYFAEQVYWSPLLNKEFKEMENRRKKQLLRDLSGLQGMNGSIQAKSIQVLPSHELVSTRIAEHLGDSQSLGRMLADYRARGGRIQPKNSDPFAHSKDASSTSSGKSGSKNEGDEERGLILSDAVWSTKVDCLNPINHQRLCVLFSSSSAQSSNAPSACVSPWIVTMEFYGKNDLTLGIFLERYCFRPSYQCPSMFCDTPMVHHIRRFVHGQGCVQIILKELDSPVPGYQHTILTYSWCRICKQVTPVVALSNESWSMSFAKYLELRFYGHQYTRRANAEPCGHSIHHDYHQYFSYNQMVASFSYSPIRLLEVCVPLPKIFIKRQAPLKVSLLQDLKDFFQKVSQVYVAIDERLASLKTDTFSKTREEKMEDIFAQKEMEEGEFKNWIEKMQARLMSSSVDTPQQLQSVFESLIAKKQSLCEVLQAWNNRLQDLFQQEKGRKRPSVPPSPGRLRQGEESKISAMDASPRNISPGLQNGEKEDRFLTTLSSQSSTSSTHLQLPTPPEVMSEQSVGGPPELDTASSSEDVFDGHLLGSTDSQVKEKSTMKAIFANLLPGNSYNPIPFPFDPDKHYLMYEHERVPIAVCEKEPSSIIAFALSCKEYRNALEELSKATQWNSAEEGLPTNSTSDSRPKSSSPIRLPEMSGGQTNRTTETEPQPTKKASGMLSFFRGTAGKSPDLSSQKRETLRGADSAYYQVGQTGKEGTENQGVEPQDEVDGGDTQKKQLINPHVELQFSDANAKFYCRLYYAGEFHKMREVILDSSEEDFIRSLSHSSPWQARGGKSGAAFYATEDDRFILKQMPRLEVQSFLDFAPHYFNYITNAVQQKRPTALAKILGVYRIGYKNSQNNTEKKLDLLVMENLFYGRKMAQVFDLKGSLRNRNVKTDTGKESCDVVLLDENLLKMVRDNPLYIRSHSKAVLRTSIHSDSHFLSSHLIIDYSLLVGRDDTSNELVVGIIDYIRTFTWDKKLEMVVKSTGILGGQGKMPTVVSPELYRTRFCEAMDKYFLMVPDHWTGLGLNC

SEQ ID NO: 27384 - protein, 2098 aa, Homo sapiens
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQDSDLKQYWMPDSQCKECYDCSEKFTTFRRRHHCRLCGQIFCSRCCNQEIPGKFMGYTGDLRACTYCRKIALSYAHSTDSNSIGEDLNALSDSACSVSVLDPSEPRTPVGSRKASRNIFLEDDLAWQSLIHPDSSNTPLSTRLVSVQEDAGKSPARNRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLANSASPSKRTSVSSFQSTVDSDSAASISLNVELDNVNFHIKKPSKYPHVPPHPADQKEYLISDTGGQQLSISDAFIKESLFNRRVEEKSKELPFTPLGWHHNNLELLREENGEKQAMERLLSANHNHMMALLQQLLHSDSLSSSWRDIIVSLVCQVVQTVRPDVKNQDDDMDIRQFVHIKKIPGGKKFDSVVVNGFVCTKNIAHKKMNSCIKNPKILLLKCSIEYLYREETKFTCIDPIVLQEREFLKNYVQRIVDVRPTLVLVEKTVSRIAQDMLLEHGITLVINVKSQVLERISRMTQGDLVMSMDQLLTKPHLGTCHKFYMQIFQLPNEQTKTLMFFEGCPQHLGCTIKLRGGSDYELARVKEILIFMICVAYHSQLEISFLMDEFAMPPTLMQNPSFHSLIEGRGHEGAVQEQYGGGSIPWDPDIPPESLPCDDSSLLESRIVFEKGEQENKNLPQAVASVKHQEHSTTACPAGLPCAFFAPVPESLLPLPVDDQQDALGSELPESLQQTVVLQDPKSQIRAFRDPLQDDTGLYVTEEVTSSEDKRKTYSLAFKQELKDVILCISPVITFREPFLLTEKGMRCSTRDYFAEQVYWSPLLNKEFKEMENRRKKQLLRDLSGLQGMNGSIQAKSIQVLPSHELVSTRIAEHLGDSQSLGRMLADYRARGGRIQPKNSDPFAHSKDASSTSSGKSGSKNEGDEERGLILSDAVWSTKVDCLNPINHQRLCVLFSSSSAQSSNAPSACVSPWIVTMEFYGKNDLTLGIFLERYCFRPSYQCPSMFCDTPMVHHIRRFVHGQGCVQIILKELDSPVPGYQHTILTYSWCRICKQVTPVVALSNESWSMSFAKYLELRFYGHQYTRRANAEPCGHSIHHDYHQYFSYNQMVASFSYSPIRLLEVCVPLPKIFIKRQAPLKVSLLQDLKDFFQKVSQVYVAIDERLASLKTDTFSKTREEKMEDIFAQKEMEEGEFKNWIEKMQARLMSSSVDTPQQLQSVFESLIAKKQSLCEVLQAWNNRLQDLFQQEKGRKRPSVPPSPGRLRQGEESKISAMDASPRNISPGLQNGEKEDRFLTTLSSQSSTSSTHLQLPTPPEVMSEQSVGGPPELDTASSSEDVFDGHLLGSTDSQVKEKSTMKAIFANLLPGNSYNPIPFPFDPDKHYLMYEHERVPIAVCEKEPSSIIAFALSCKEYRNALEELSKATQWNSAEEGLPTNSTSDSRPKSSSPIRLPEMSGGQTNRTTETEPQPTKKASGMLSFFRGTAGKSPDLSSQKRETLRGADSAYYQVGQTGKEGTENQGVEPQDEVDGGDTQKKQLINPHVELQFSDANAKFYCRLYYAGEFHKMREVILDSSEEDFIRSLSHSSPWQARGGKSGAAFYATEDDRFILKQMPRLEVQSFLDFAPHYFNYITNAVQQKRPTALAKILGVYRIGYKNSQNNTEKKLDLLVMENLFYGRKMAQVFDLKGSLRNRNVKTDTGKESCDVVLLDENLLKMVRDNPLYIRSHSKAVLRTSIHSDSHFLSSHLIIDYSLLVGRDDTSNELVVGIIDYIRTFTWDKKLEMVVKSTGILGGQGKMPTVVSPELYRTRFCEAMDKYFLMVPDHWTGLGLNC

SEQ ID NO: 27385 - protein, 1419 aa, Homo sapiens
MAEGLERVRISASELRGILATLAPQAGSRENMKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKTSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 27386 - protein, 129 aa, Homo sapiens
MGRRDAQLLAALLVLGLCALAGSEKPSPCQCSRLSPHNRTNCGFPGITSDQCFDNGCCFDSSVTGVPWCFHPLPKQESDQCVMEVSDRRNCGYPGISPEECASRKCCFSNFIFEVPWCFFPKSVEDCHY

SEQ ID NO: 27387 - protein, 245 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDMIWDRGALVAINPGDRKCYADTMFSLLGKKFQYLLCVLSYDPTKHPGPPFYVPHAEIERLFGKICNIRCLEKVDAFEERHKSWGIDCLFEKLYLLTEK

SEQ ID NO: 27388 - protein, 530 aa, Homo sapiens
MSLKWTSVFLLIQLSCYFSSGSCGKVLVWPTEYSHWINMKTILEELVQRGHEVTVLTSSASTLVNASKSSAIKLEVYPTSLTKNDLEDSLLKILDRWIYGVSKNTFWSYFSQLQELCWEYYDYSNKLCKDAVLNKKLMMKLQESKFDVILADALNPCGELLAELFNIPFLYSLRFSVGYTFEKNGGGFLFPPSYVPVVMSELSDQMIFMERIKNMIHMLYFDFWFQIYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPVYKENVMKLSRIHHDQPMKPLDRAVFWIEFVMRHKGAKHLRVAAHNLTWIQYHSLDVIAFLLACVATVIFIITKFCLFCFRKLAKTGKKKKRD

SEQ ID NO: 27389 - protein, 387 aa, Homo sapiens
MVFAFWKVFLILSCLAGQVSVVQVTIPDGFVNVTVGSNVTLICIYTTTVASREQLSIQWSFFHKKEMEPISIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 27390 - DNA, 17 bp, Homo sapiens
gatctggcctctgtcct

SEQ ID NO: 27391 - DNA, 17 bp, Homo sapiens
gatccagcctctgtcct

SEQ ID NO: 27392 - DNA, 17 bp, Homo sapiens
gatcctttcttagaaac

SEQ ID NO: 27393 - DNA, 17 bp, Homo sapiens
gatctgactccaaaacc

SEQ ID NO: 27394 - DNA, 17 bp, Homo sapiens
gatcattctgaagcaaa

SEQ ID NO: 27395 - DNA, 17 bp, Homo sapiens
gatctgccatggacatg

SEQ ID NO: 27396 - DNA, 17 bp, Homo sapiens
gatctcaaatgtcaacc

SEQ ID NO: 27397 - DNA, 17 bp, Homo sapiens
gatcaagcagccccaag

SEQ ID NO: 27398 - DNA, 17 bp, Homo sapiens
gatccttttcatgaagt

SEQ ID NO: 27399 - DNA, 17 bp, Homo sapiens
gatcaaaaataaactag

SEQ ID NO: 27400 - DNA, 17 bp, Homo sapiens
gatccatattcaagtgg

SEQ ID NO: 27401 - DNA, 17 bp, Homo sapiens
gatcacaacgtgagaaa

SEQ ID NO: 27402 - DNA, 17 bp, Homo sapiens
gatctgagaatttctgg

SEQ ID NO: 27403 - DNA, 17 bp, Homo sapiens
gatcagtttattttgta

SEQ ID NO: 27404 - DNA, 17 bp, Homo sapiens
gatcccagagagcagct

SEQ ID NO: 27405 - DNA, 17 bp, Homo sapiens
gatcaccacgctgccac

SEQ ID NO: 27406 - DNA, 17 bp, Homo sapiens
gatccaaagctctccag

SEQ ID NO: 27407 - DNA, 17 bp, Homo sapiens
gatctgccagtaaccct

SEQ ID NO: 27408 - DNA, 17 bp, Homo sapiens
gatctggcctccgtcct

SEQ ID NO: 27409 - DNA, 17 bp, Homo sapiens
gatcttcctgggaggtg

SEQ ID NO: 27410 - DNA, 17 bp, Homo sapiens
gatccacaggggctggc

SEQ ID NO: 27411 - DNA, 17 bp, Homo sapiens
gatcctcggggatgtct

SEQ ID NO: 27412 - DNA, 17 bp, Homo sapiens
gatcactttttaaaata

SEQ ID NO: 27413 - DNA, 17 bp, Homo sapiens
gatctgtcacattacta

SEQ ID NO: 27414 - DNA, 17 bp, Homo sapiens
gatctatattcctagtc

SEQ ID NO: 27415 - DNA, 17 bp, Homo sapiens
gatcagtgcgtcatgga

SEQ ID NO: 27416 - DNA, 17 bp, Homo sapiens
gatccgactcttgcttt

SEQ ID NO: 27417 - DNA, 17 bp, Homo sapiens
gatccatgtgctggaat

SEQ ID NO: 27418 - DNA, 17 bp, Homo sapiens
gatccttttctgtttca

SEQ ID NO: 27419 - DNA, 17 bp, Homo sapiens
gatctgaaaataaagtg

SEQ ID NO: 27420 - DNA, 17 bp, Homo sapiens
gatctattttagataat

SEQ ID NO: 27421 - DNA, 17 bp, Homo sapiens
gatctaatcataactta

SEQ ID NO: 27422 - DNA, 17 bp, Homo sapiens
gatccattccacttata

SEQ ID NO: 27423 - DNA, 3519 bp, Homo sapiens
gcagaagcggtcgtcaggggcgtggcggcagttacttgggcggggccggtagcggcgggagctgcactggccaggggttccggctgtatatccatgagcgccgctggcagccggggagctgcaggaaccagactgggggcgagctgagcacctgtagtcaatcacacgcagaaataataatgatacttatgttagaagattgttttgagaagtgcatggagttactacatctgaagcatttagaacagtacctggcacagggttctgtcctcttcatttgcaagccactgctttatccacgagggtgctccctacttatgccagtgaattaatttttggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaaaaaaaaaaaaaaaaaaaaaa

SEQ ID NO: 27424 - DNA, 3121 bp, Homo sapiens
gcagaagcggtcgtcaggggcgtggcggcagttacttgggcggggccggtagcggcgggagctgcactggccaggggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaaaaaaaaaaaaaaaaaaaaaa

SEQ ID NO: 27425 - DNA, 1388 bp, Homo sapiens
caggcagtgcaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctgtgcaagagagatatgtggagaaaatcatcattcatgaaaaatacaactctgcgacagagggaaatgacattgccctcgtggagatcacccctcccatttcgtgtgggcgcttcattgggccgggctgcctgccccacttgaaggcaggcctccccagaggctcccagagctgctgggtggccggctggggatatatagaagagaaagcccccaggccatcatctatactgatggaggcacgtgtggatctcatcgacctggacttgtgtaactcgacccagtggtacaatgggcgcgttcagccaaccaatgtgtgcgcggggtatcctgtaggcaagatcgacacctgccagggagacagcggcgggcctctcatgtgcaaagacagcaaggaaagcgcctatgtggtcgtgggaatcacaagctggggggtaggctgtgcccgtgccaagcgccccggaatctacacggccacctggccttatctgaactggatcgcctccaagattggttctaacgctttgcgtatgattcaatcggccacccctccaccgcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatataaaaaaaaaaaaaaa

SEQ ID NO: 27426 - DNA, 2712 bp, Homo sapiens
ccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggtttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttg

SEQ ID NO: 27427 - DNA, 1852 bp, Homo sapiens
caccacgtgcagccgctctcgtgcaggcgtttgcagtgtgcagctgagttcggcagctcacacagcacccctttcaagttgttttgcagtgggtgcctcttgtgagacactgtttctgagagcagcttttgtggcatcttacagggcagatttctggtcccacccacctctgcctccgccatggcttcaagaaccgttatcattgaccacgggtctggctttttgaaggctggcacggccggatggaatgagcctcagatggtcttcccgaacatcgtgaactacctaccgtgcaaggagaaccctggccccagctatgcccgtaggcgtgtgagcctgggcatcgacatttgccatcctgacacctttagctaccccatcgagcggggccgcatcctcaactgggagggtgtgcagtacctctggtcatttgtgttggagaaccacagacgggagcaagaggtcccccctgtgatcatcacggagacacccttgagggagcctgcggaccgaaagaagatgctggagatcctgtttgagttgctgcatgtcccatcggtcctcctggccgaccagctgcagatgtccctgtatgcctctggcctcctgaccggagtggtggttgattctggctatggcctgacccgcgtgcagcctttccaccagggccgccccttgcccgccagcggcaagacgctggagttcgccggccaggatctctccgcctatctcctcaagagtctctttaaggaagattgcgatagacgctgcctgtttcagctggagacagtcgccgtgactcagatgaacaagtgctacgtgccgcagaatctgggggaggccctggactttcgtgagaggcagcagagtgccttggatgagagcaacacctatcagctcccagacggctcccgcgtggagctgacccccatgcagcgggtggctcctgagatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggagctgatgggggatcacgtctcctccaccaaggccacagtctgggagggttccaatagaaactttagtgtctggctaggagcgtccgtggtggctcacctttctacctaccagtctgagtggatgtcccgagaggagtatggtgagcatatgaggatgtgaccctactggctcactcctgagaatgggctcctgttagatgggcacgggcggattaattttagcaaaatgttctgggtgggggtagaatgaggtggggtggggtgagctggctttggaattctaggggcatgagggtattttttaggttctaaggttttatcttgttgcaagagtgggacctacccaagggggaagacaagatgtcatccttggaaaccctgcaggggacagtttttccagggtggcctatcattggggtatgagtggctgactgccatctccatgcctgagagccactgatttttcattggcatttcccctggtttgtctcattcttcttggttgagtaggttttaactggggtagcactcctgctaggagtcccaattatttttgactaggggatgggggacagttgacatttctggtcctacaggccctttctggccagggaggcattgctgcaggtgagcctgggatgcccttgccacccgtggttggatcttgttttatatctgcaaataaatagcttgtttggaagcaaaaaaaaaaaaaaaaaaaaaaaaaaaaa

SEQ ID NO: 27428 - DNA, 2657 bp, Homo sapiens
gcgtcatctcgcgcttccaactgccctgtaaccaccaactgccattattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaaaaaaaaaaaaaaaa

SEQ ID NO: 27429 - DNA, 2406 bp, Homo sapiens
atggcagtggatgggaccctcgtgtacatcagggtcactcttctgctgctctggcttggggtatttttgtctatttccggctactgtcaggctgggccctcccagcatttcacttccccggaagtggtgatccccttgaaggtgatcagcaggggcagaagtgcaaaggctcctggatggctctcctatagtctgcggtttgggggccagaaacacgttgttcatatgagggtcaagaagctcttagtttctagacacctcccagtgttcacctacacagatgagcgtgcactcctggaggatcagctcttcatcccagatgactgttactatcatggttacgtggagggtgcccctgagtctctggttgtgttcagtgcttgttttgggggctttcgaggagtattaaaaataagtggcctcacttatgaaattgaacccatcaggcactctgccacatttgaacacctggtttacaaagtaaacagtaatgagacacaattcccagctatgagatgtggcttaacagagaaggaagtagcacgccaacagttggaatttgaagaggctgagaactcagctctggaaccaaaatctgctggtgactggtggactcatgcatggtttctggagctagttgttgtggtgaaccatgatttcttcatttactctcaaagcaacatctcaaaggtgcaagaggatgtatttcttgttgtcaacatagtggattccatgtatcagcagttaggtacttacataattttgattggaattgaaatttggaatcaaggaaatgttttcccaatgacaagcatagaacaggtcctgaacgatttctctcaatggaaacaaatcagtctttcccagctacagcatgatgctgcacatatgttcataaaaaattcacttataagtatacttggcctagcctatgttgcaggaatatgtcgtccacctattgattgtggagttgataattttcaaggagatacctggtctctttttgccaacactgtggcccatgagttaggtcatacgttgggtatgcagcatgatgaagaattctgtttttgtggggaaagaggttgcatcatgaatacttttagagtgccagcagagaaattcaccaattgcagttacgctgattttatgaagaccaccttaaaccagggatcatgtctgcataatcctccaagattgggggaaatctttatgctaaagcgctgtgggaatggtgtggttgaaagagaagagcagtgtgactgtggatccgtacagcagtgtgaacaagacgcctgttgtctgttgaactgcactctaaggcctggggctgcctgtgcttttgggctttgttgcaaagactgcaagttcatgccatcaggggaactctgtagacaagaggtcaatgaatgtgaccttccagaatggtgcaatggaacatctcatcagtgtccagaagatagatatgtgcaggacgggatcccctgtagtgacagtgcctactgctatcaaaagaggtgtaataaccatgaccagcattgcagggagatttttggtaaagatgcaaaaagtgcatctcagaattgctataaagaaatcaactctcagggaaaccgttttggtcactgtggtataaatggcacaacatacctaaaatgtcatatctctgatgtcttttgtgggagagttcaatgtgagaatgtgagagacattcctcttctccaagatcattttactttgcagcacactcatatcaatggtgtcacctgctggggtattgactatcatttaaggatgaacatatctgacattggtgaagtgaaagatggtactgtgtgtggcccaggaaagatctgcatccataagaagtgtgtcagtctgtctgtcttgtcacatgtctgccttcctgagacctgcaatatgaaggggatctgcaataacaaacatcactgccactgtggctatgggtggtccccaccctactgccagcacagaggctatgggggcagtattgacagtggcccagcatctgcaaagagaggagtttttttgccgctgattgtgattccttctttgtctgttttgactttcctgtttactgtcgggcttcttatgtatctacgacaatgttctggtcccaaagaaactaaggctcattcatcaggttaagaaaatgtctctaacttaatattccatgcattagtacactttagtctcttggcagtagaaacattagtacatccctgaaactgagcacatttctgaccatttccagaaagctgcaaagatcttcccttacattagtaccacaaacattgtcattaagttcaagttattcttaacatgtttctatctattgtttattgttttaagcagcaaataaagctacatccttccctcccttta

SEQ ID NO: 27430 - DNA, 2972 bp, Homo sapiens
gagccctgggaggctacgggctcccccggaaaccctgccaggggagccgggttttgagctcaggcgcctctagcggcggcccccagaaatctgactcgcgaggccagagttgcagggactgaatagcaaactgaggctgagtagggaacagaccatgaggtcagtgcagatcttcctctcccaatgccgtttgctccttctactagttccgacaatgctccttaagtctcttggcgaagatgtaatttttcaccctgaaggggagtttgactcgtatgaagtcaccattcctgagaagctgagcttccggggagaggtgcagggtgtggtcagtcccgtgtcctacctactgcagttaaaaggcaagaagcacgtcctccatttgtggcccaagagacttctgttgccccgacatctgcgcgttttctccttcacagaacatggggaactgctggaggatcatccttacataccaaaggactgcaactacatgggctccgtgaaagagtctctggactctaaagctactataagcacatgcatggggggtctccgaggtgtatttaacattgatgccaaacattaccaaattgagcccctcaaggcctctcccagttttgaacatgtcgtctatctcctgaagaaagagcagtttgggaatcaggtttgtggcttaagtgatgatgaaatagaatggcagatggccccttatgagaataaggcgaggctaagggactttcctggatcctataaacacccaaagtacttggaattgatcctactctttgatcaaagtaggtataggtttgtgaacaacaatctttctcaagtcatacatgatgccattcttttgactgggattatggacacctactttcaagatgttcgtatgaggatacacttaaaggctcttgaagtatggacagattttaacaaaatacgcgttggatatccagagttagctgaagttttaggcagatttgtaatatataaaaaaagtgtattaaatgctcgcctgtcatcagattgggcacatttatatcttcaaagaaaatataatgatgctcttgcatggtcgtttggaaaagtgtgttctctagaatatgctggatcagtgagtactttactagatacaaatatccttgcccctgctacctggtctgctcatgagctgggtcatgctgtaggaatgtcacatgatgaacaatactgccaatgtaggggtaggcttaattgcatcatgggctcaggacgcactgggtttagcaattgcagttatatctctttttttaaacatatctcttcgggagcaacatgtctaaataatatcccaggactaggttatgtgcttaagagatgtggaaacaaaattgtggaggacaatgaggaatgtgactgtggttccacagaggagtgtcagaaagatcggtgttgccaatcaaattgtaagttgcaaccaggtgccaactgtagcattggactttgctgtcatgattgtcggtttcgtccatctggatacgtgtgtaggcaggaaggaaatgaatgtgaccttgcagagtactgcgacgggaattcaagttcctgcccaaatgacgtttataagcaggatggaaccccttgcaagtatgaaggccgttgtttcaggaaggggtgcagatccagatatatgcagtgccaaagcatttttggacctgatgccatggaggctcctagtgagtgctatgatgcagttaacttaataggtgatcaatttggtaactgtgagattacaggaattcgaaattttaaaaagtgtgaaagtgcaaattcaatatgtggcaggctacagtgtataaatgttgaaaccatccctgatttgccagagcatacgactataatttctactcatttacaggcagaaaatctcatgtgctggggcacaggctatcatctatccatgaaacccatgggaatacctgacctaggtatgataaatgatggcacctcctgtggagaaggccgggtatgttttaaaaaaaattgcgtcaatagctcagtcctgcagtttgactgtttgcctgagaaatgcaatacccggggtgtttgcaacaacagaaaaaactgccactgcatgtatgggtgggcacctccattctgtgaggaagtggggtatggaggaagcattgacagtgggcctccaggactgctcagaggggcgattccctcgtcaatttgggttgtgtccatcataatgtttcgccttattttattaatcctttcagtggtttttgtgtttttccggcaagtgataggaaaccacttaaaacccaaacaggaaaaaatgccactatccaaagcaaaaactgaacaggaagaatctaaaacaaaaactgtacaggaagaatctaaaacaaaaactggacaggaagaatctgaagcaaaaactggacaggaagaatctaaagcaaaaactggacaggaagaatctaaagcaaacattgaaagtaaacgacccaaagcaaagagtgtcaagaaacaaaaaaagtaaccgggcaatccatactcattcagtaacacaggctcatttatttaaccagctaatcatttatccaaaggctttccattcttctcccaatatttttttactttaatttttcccacaagttttgatcagcaaataaacagcattcttgttttggaaacaaaccagtgcattctacttctcgagtgttcacttgcccctcagtttgtgaccaagttgtgggtattctgagaatcatgctctaatggcttttccatacactaaagctctgaaagtagtgagtttcctagaattaccatgctattcaaggtatagtcttgtttctcagaatcccagggaacaaagcaattgtctgcctctccctctgcctccctcaacttgatccatgtgaacatccgcacctgcacccatgctgatcaataaatgccgacaacacaaaaaaaaaaaaaaa

SEQ ID NO: 27431 - DNA, 2582 bp, Homo sapiens
atccctgcagtggaagtgaggaggaagaaaggtgaactccttttctcaagcacttctgctctcctctaccagaatcactcagaatgcttcccgggtgtatattcttgatgattttactcattcctcaggttaaagaaaagttcatccttggagtagagggtcaacaactggttcgtcctaaaaagcttcctctgatacagaagcgagatactggacacacccatgatgatgacatactgaaaacgtatgaagaagaattgttgtatgaaataaaactaaatagaaaaaccttagtccttcatcttctaagatccagggagttcctaggctcaaattacagtgaaacattctactccatgaaaggagaagcgttcaccaggcatcctcagatcatggatcattgtttttaccaaggatccatagtacacgaatatgattcagctgccagtatcagtacgtgtaatggtctaaggggattcttcagaataaacgaccaaagatacctcattgaaccagtgaaatactcagatgagggagaacatttggtgttcaaatataacctgagggtgccgtatggtgccaattattcctgtacagagcttaattttaccagaaaaactgttccaggggataatgaatctgaagaagactccaaaataaaaggcatccatgatgaaaagtatgttgaattgttcattgttgctgatgatactgtgtatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggagtgtactaatccttgctgtgatgcacacacatgtgtactgaagccaggatttacttgtgcagaaggagaatgctgtgaatcttgtcagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatgatgcaatagagagtcatgatatctgctacaagatgaatacaaaaggaaataaatttggatactgcaaaaacaaggaaaacagatttcttccctgtgaggagaaagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaataaacctgcaagtaaagattcaagaggaatcgcagatcccaatcaaagtgccaagtgagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcagaaaaaaaaaaaaaaaaaaaa

SEQ ID NO: 27432 - DNA, 1769 bp, Homo sapiens
ctccatttaatggcgcggacgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaaaaaaaaaaaaaaaa

SEQ ID NO: 27433 - DNA, 1826 bp, Homo sapiens
gcatggtggggaggagctgtggggtggcaacccagaggcaaggaggtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaaaaaaaaaaaaaaaa

SEQ ID NO: 27434 - DNA, 3694 bp, Homo sapiens
cggagccccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgcagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaatttgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaaaaaaaaaaaa

SEQ ID NO: 27435 - DNA, 3027 bp, Homo sapiens
ggtacatggaaggccacaggaagaaacaagatcttgagctgagcaagaacatcccagcatcttcattgactttaaaagtatattctggagtcttccgtggttcactattccagtactacagagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgggagttcagtagatgaagtttccttctatgctaaccgcctcacgaatctagtcatagccatggcccgcaaagagatcaatgagaagatcgatggctctgaaaacaaatgtgtctatcagtcattgtacatggggaatgaacccacacccaccaaaagcctcagtaagatagcatcagagcttgtgaatgagaccgtctctgcatgttccaggaatgctgccccagacaaggctcctggctctggagacagagtctcgggatcatcacaaagtcccccaaatttgaaatacaagtccactttgaagatcaaggagagcaccaaagaaagacagggtccagatgacaagcctccttctaagaagtctttcttctataaggaagtgtttgaatctcgtaatggagattatgccagagagggtggaaggttctttcctcgggagagaaagaggtttcgagggcaggaaaggcctgatgactttacggcttctgttagtgaagggatcatgacctatgctaacagtgtggtatctgatatgatggtctccatcatgaagacactgaagatccaagtgaaagacacaaccattgccaccatcctactgaagaaggttctgctcaagcatgcaaaagaggtggtctcggatctcatcgactccttcttgaggaatctccacagcgtcacagggaccctcatgactgacacacagtttgtctcggctgtgaaaagaactgtcttctctcatggaagccaaaaggccacagatatcatggatgccatgctaaggaagctgtacaatgtaatgtttgccaagaaagtccctgagcatgtcaggaaagcccaagacaaggctgagagttattccctcatctccatgaaaggaatgggtgatcctaaaaaccgaaatgtgaactttgccatgaaatctgaaactaaattgagagaaaaaatgtattctgaacccaaatcagaggaggagacttgtgcgaaaactctgggtgagcacattatcaaagaggggcttaccttgtggcataaaactcagcagaaagaatgtaaatctctaggtttccagcatgcagcatttgaagctcccaacacacagcgtaagcctgcatcagacatttcctttgagtaccctgaagatattggcaacctcagccttcctccatatcctccagagaaacctgagaattttatgtatgattcagactcctgggccgaggacctgatcgtgtctgccctgcttctgattcaatatcacctggcccagggaggaagaagggatgcacggagcttcgttgaagctgctggcaccaccaactttcctgccaatgaacctcctgtagctcccgatgaatcttgccttaagtctgctcccattgtaggtgaccaagaacaagcagaaaagaaggacctaaggagtgttttctttaatttcatccggaacttacttagtgagaccattttcaagcgtgaccagagccctgaacccaaggtgccggaacagccagttaaggaagataggaagttgtgtgaaagaccgttggcgtcttctccccccaggctatatgaggatgatgagacccctggtgccctttctgggctgaccaagatggctgtcagccagatagatggccacatgagtgggcagatggtagaacatctgatgaactcagtgatgaagctgtgtgtcatcattgctaagtcctgtgatgcttcgttggcagagctgggagatgacaagtctggagatgccagtaggctaacttcggccttcccagatagtttatatgagtgcttaccagccaagggcacagggtcagcagaagctgtcctgcagaatgcctatcaagctatccataatgaaatgagaggcacatcaggacagccccctgaagggtgtgcagcacccacggtgattgtcagcaatcacaacctaacggacacagttcagaacaagcaactccaagccgtccttcaatgggtagctgcctctgagctcaatgtccctattttgtattttgctggtgatgatgaagggatccaggagaagctacttcagctctcagctgctgctgtggacaaaggatgcagtgtgggcgaggttctgcagtcggtgctgcgctatgagaaggagcgccagctgaatgaggcggtggggaatgtcacaccgctgcagctgctggactggctgatggtgaacctgtaatcggcaaccccactgctttcccctcttctggcagtggggccggcccttatccccgcccttctttctcacttccacatctccccctctatatcctcacagagccctaacattatcttcacaccactctcatcaaagacatgtcatcttgtgctagccactggattttgcagattttcctgtccatgcaagcaaggacgtaaaattaaaaaattacaattaaagggctccaaaaaaaa

SEQ ID NO: 27436 - DNA, 2881 bp, Homo sapiens
ccagctggcagtcaaggctgtaggagggcatggagagttgaagaaaaaagcagtatcttgaggcagactggaagagtcatcacagcatccaaatcaacaagaaaacatcattccagggtcctacatgatggcgtactctgatactacaatgatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaagtccttcagctcctccagccaaacctcctagcactcagagagcagtcatttcccctgatggagaatgttctatagatgacctttccttctacgtcaaccgactatcttctctggtaatccagatggcccataaggaaatcaaggagaagttggaaggtaaaagcaaatgccttcatcattcaatctgtccatcccctgggaacaaagagagaatcagtccccgaactcctgcgagcaagattgcttctgaaatggcctatgaagctgtggaactgacagctgcagaaatgcgtggcactggagaggagtccagggaaggtggccagaaaagctttctatatagcgaattatccaacaagagcaaaagtggagacaaacagatgtcccagagagagagcaaagaatttgcagattccatcagcaaggggctcatggtttatgcaaatcaggtggcatctgacatgatggtctctctcatgaagaccttgaaagtgcacagctctgggaagccaattccagcatctgtggtcctgaagagggtgttgctaaggcacaccaaggagattgtgtccgatttgattgattcttgcatgaagaacctgcataatattactggggtcctgatgactgactcagactttgtctcagctgtcaagagaaatctgttcaaccagtggaaacaaaatgctacagacatcatggaggccatgctgaagcgcttggtcagtgcccttataggtgaggagaaggagactaagtctcagagtctgtcatatgcatctttaaaagctgggtcccatgatcccaaatgcaggaatcagagtcttgaattctccaccatgaaagctgaaatgaaagagagggacaaaggcaaaatgaaatcagacccatgcaagtcactgactagtgctgagaaagtcggtgaacacattctcaaagagggcctaaccatctggaaccaaaagcaaggaaactcatgcaaggtggctaccaaagcatgcagcaataaagatgagaaaggagaaaagatcaatgcttccacagattcactggccaaggacctgattgtctctgcccttaagctgatccagtaccatctgacccagcagactaagggcaaagatacatgtgaagaagactgtcctggttccaccatgggctatatggctcagagtactcaatatgaaaagtgtggaggtggccaaagtgccaaagcactttcagtgaaacaactagaatctcacagagcccctggaccatccacctgtcaaaaggagaaccaacacctggactcccagaaaatggatatgtcaaacatcgttctaatgctgattcagaaactgcttaatgagaaccccttcaaatgtgaggatccatgcgaaggtgagaacaagtgttctgagcccagggcaagcaaagcagcttccatgtccaacagatctgacaaagcggaagaacaatgccaggagcatcaagaacttgactgtaccagtgggatgaagcaagcgaacgggcaatttatagataaactagtagaatctgtgatgaagctctgccttatcatggctaagtatagcaacgatggggcagcccttgctgagttggaagaacaagcagcctcggcaaataagcccaatttcaggggcaccagatgcattcacagtggtgcaatgccacagaactatcaagactctcttggacatgaagtaattgtcaataatcagtgctctacaaatagcttgcagaagcagctccaggctgtcctgcagtggattgcagcctcccagtttaacgtgcccatgctctacttcatgggagataaggatggacaactggaaaagcttcctcaggtttcagctaaagcagcagagaaggggtacagtgtaggaggtcttcttcaagaggtcatgaagtttgccaaggaacggcaaccagatgaagctgtgggaaaggtggccaggaaacagttgctggactggctgctcgctaacctgtgagctgatccttgactcctcttcatcttagcccccctagcagcattccatcccagccagagcacccccaccatcaggccagtcaactgcacaatacacaactgtatttcccaatacacttgagcagttgcctgtgaatgtaagaggtgtcaacaaactgggaaataaaataaaaaaaaataataataaatgtgt

SEQ ID NO: 27437 - DNA, 2867 bp, Homo sapiens
caggggtggcagccaactgcaggtgcccaagaacttggcacttctcagttccatctaaaggggcacatctcccttctgggtgtcacgttttcagccaaacatctaaaagaacttcatcatcaagatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaagtccttcagctcctccagccaaacctcctagcactcagagagcagtcatttcccctgatggagaatgttctatagatgacctttccttctacgtcaaccgactatcttctctggtaatccagatggcccataaggaaatcaaggagaagttggaaggtaaaagcaaatgccttcatcattcaatctgtccatcccctgggaacaaagagagaatcagtccccgaactcctgcgagcaagattgcttctgaaatggcctatgaagctgtggaactgacagctgcagaaatgcgtggcactggagaggagtccagggaaggtggccagaaaagctttctatatagcgaattatccaacaagagcaaaagtggagacaaacagatgtcccagagagagagcaaagaatttgcagattccatcagcaaggggctcatggtttatgcaaatcaggtggcatctgacatgatggtctctctcatgaagaccttgaaagtgcacagctctgggaagccaattccagcatctgtggtcctgaagagggtgttgctaaggcacaccaaggagattgtgtccgatttgattgattcttgcatgaagaacctgcataatattactggggtcctgatgactgactcagactttgtctcagctgtcaagagaaatctgttcaaccagtggaaacaaaatgctacagacatcatggaggccatgctgaagcgcttggtcagtgcccttataggtgaggagaaggagactaagtctcagagtctgtcatatgcatctttaaaagctgggtcccatgatcccaaatgcaggaatcagagtcttgaattctccaccatgaaagctgaaatgaaagagagggacaaaggcaaaatgaaatcagacccatgcaagtcactgactagtgctgagaaagtcggtgaacacattctcaaagagggcctaaccatctggaaccaaaagcaaggaaactcatgcaaggtggctaccaaagcatgcagcaataaagatgagaaaggagaaaagatcaatgcttccacagattcactggccaaggacctgattgtctctgcccttaagctgatccagtaccatctgacccagcagactaagggcaaagatacatgtgaagaagactgtcctggttccaccatgggctatatggctcagagtactcaatatgaaaagtgtggaggtggccaaagtgccaaagcactttcagtgaaacaactagaatctcacagagcccctggaccatccacctgtcaaaaggagaaccaacacctggactcccagaaaatggatatgtcaaacatcgttctaatgctgattcagaaactgcttaatgagaaccccttcaaatgtgaggatccatgcgaaggtgagaacaagtgttctgagcccagggcaagcaaagcagcttccatgtccaacagatctgacaaagcggaagaacaatgccaggagcatcaagaacttgactgtaccagtgggatgaagcaagcgaacgggcaatttatagataaactagtagaatctgtgatgaagctctgccttatcatggctaagtatagcaacgatggggcagcccttgctgagttggaagaacaagcagcctcggcaaataagcccaatttcaggggcaccagatgcattcacagtggtgcaatgccacagaactatcaagactctcttggacatgaagtaattgtcaataatcagtgctctacaaatagcttgcagaagcagctccaggctgtcctgcagtggattgcagcctcccagtttaacgtgcccatgctctacttcatgggagataaggatggacaactggaaaagcttcctcaggtttcagctaaagcagcagagaaggggtacagtgtaggaggtcttcttcaagaggtcatgaagtttgccaaggaacggcaaccagatgaagctgtgggaaaggtggccaggaaacagttgctggactggctgctcgctaacctgtgagctgatccttgactcctcttcatcttagcccccctagcagcattccatcccagccagagcacccccaccatcaggccagtcaactgcacaatacacaactgtatttcccaatacacttgagcagttgcctgtgaatgtaagaggtgtcaacaaactgggaaataaaataaaaaaaaataataaaaaaaaaaaaaaaaaaaaaaaa

SEQ ID NO: 27438 - DNA, 1668 bp, Homo sapiens
agtgtttccctccgagggcactgcgtgccgcgcaggcgcaaagggccaggtgctggaggtgctgtcatggcctgcctcaacccggtgcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaattacac

SEQ ID NO: 27439 - DNA, 1656 bp, Homo sapiens
agtgtttccctccgagggcactgcgtgccgcgcaggcgcaaagggccaggtgctggaggtgctgtcatggcctgcctcaacccggtgcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataaggcattcccaagaaggacatcgtttaacacctaaactcatttaacaaaggatccgagaagaacagggacagtgtgggaagaaatcttcttgtgatggcatatttgcttcctatatttcttctggaatcatgttcgcttggcttcctgattaaaaacacagttttattgctctctgcactgccaaaccaataaatttacagaagagaaagctgtattccactgtaccccttgcagcatcaataaaactgacagccaaaaaaaa

SEQ ID NO: 27440 - DNA, 6222 bp, Homo sapiens
gggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccaaaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctcctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcaatggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaa

SEQ ID NO: 27441 - DNA, 2117 bp, Homo sapiens
agcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacaccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatgtttatgaatcttgcaccacctccagaaagaacagatcccgtgacaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcaacctgaagaggagcttgaaaatattgtaggagtagatatccctcttgtaaatgaggaagctgaaactactgcaaatgagttactggataatgattctgagaaaggcctgactataccaactttgaaccaatcggaccaagataattcaactgctgatgcttctaaaaatgatgaatcaacaccttcacccacagaagtgcactcattgtgcactatttctaaccaggaaacaataaaagcaggcagaataccacctttaggtgaacgtcaatcagaaagcatgccagacagaaaaatgaaaaatgtattttttccattagaagtaaaattaaaagataactatccaagcattttaaaagcagactcatctctatcagaggtggctttttcaccaaaagaatataattcaccatctttcagaccagaatatatagaattcaaaccaaaatttcaggattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaatgttcgctcatttgtgatattataaaacatgtttaactcagaatgatatgtgaggccagcagtcagaatatcacttctccattaacaaaatggtttggagatctcttcttttgtgtgacagaagtcagcaaccaaatttcatcttgttagaaccattttgttttgattaaaatgaaaaacaaaaaaaaaaaaaaaa

SEQ ID NO: 27442 - DNA, 1777 bp, Homo sapiens
agcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttctaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattctcatctgaatttcacagcttatcacggactcttcactgaaaaatgatgctctccatactgggagctgagctttctctgagttttgtactatttttcttctaccttgacgtatttcgttagaaagaaactgatttgaaggccttcttcatattgaacttttactatatttgggaggtgtacctttgtcccctggggcatttaggtagcaaaaaaagatgatgtgttgattttaaaaaat

SEQ ID NO: 27443 - DNA, 3511 bp, Homo sapiens
ggggatttggggctgggtcggccggggtcggggagggggttggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagacctggacgccctggacaagcagcacagaactgctctacacttggcctgtgccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaggaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaaaattcaacaacaaattttggaacataaaaagaagatacttaaaaaggagaaatcagatgttggaagttctgatgaatctgcagtcagcattttccatgaactgcgtgtggattcattgcctgcatcggatgacaaagacttgaatgttgctactaagcagtgtgtccccgagaaagtgtcagagcctttacctggatcttcgcatgaaaaaggaaacagaatagtcaatggacaaggagaagggcctcctgcaaaacatccttccttgaagcctagcactgaagtagaagatcctgctgtgaaaggagcagtacaaagaaagaatgtacagacattgagagcagaacaagccttaccagtggcttcagaggaagagcaagaaaggcatgaaagaagtgaaaagaagcaaccacaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgatagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaatcgggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaatgatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagatgagaatgagtttcttactgaacaactttctgaaacacaaattaaattcaatgccttaaaagataagttccgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacctcgtgctagaagagaaaagtaagaagctaatgaatgaatgtgatcatttaaaagaaagtctctttcagtatgagagagagaaaacagaaggagtagtaagtatcaaggaagataaatattttcaaacttctagaaagaaaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaacttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtgtttttatgaccatgtaatgttttaaaggcacctacttgttataaaatcataatttaggataaatgtggtaaaacttagcaaaactatatttggtttagttttcccactggtatttatagtttactttgaatatttatattaataattagctcataattttta

SEQ ID NO: 27444 - DNA, 3964 bp, Homo sapiens
ggggatttggggctgggtcggccggggtcggggaggggggtggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcctggcgcgcaggagcggagacctggacgccctggacaagcagcacagaactgctctacacttggcctgtgccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaggaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaaaattcaacaacaaattttggaacataaaaagaagatacttaaaaaggagaaatcagatgttggaagttctgatgaatctgcagtcagcattttccatgaactgcgtgtggattcattgcctgcatcggatgacaaagacttgaatgttgctactaagcagtgtgtccccgagaaagtgtcagagcctttacctggatcttcgcatgaaaaaggaaacagaatagtcaatggacaaggagaagggcctcctgcaaaacatccttccttgaagcctagcactgaagtagaagatcctgctgtgaaaggagcagtacaaagaaagaatgtacagacattgagagcagaacaagccttaccagtggcttcagaggaagagcaagaaaggcatgaaagaagtgaaaagaagcaaccacaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgatagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaatcgggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaattatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagatgagaatgagtttcttactgaacaactttctgaaacacaaattaaattcaatgccttaaaagataagttccgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacctcgtgctagaagagaaaagtaagaagctaatgaatgaatgtgatcatttaaaagaaagtctctttcagtatgagagagagaaaacagaaggagtagtaagtatcaaggaagataaatattttcaaacttctagaaagacaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaacttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtgtttttatgaccatgtaatgttttaaaggcacctacttgttataaaatcataatttaggataaatgtggtaaaacttagcaaaactatatttggtttagttttcccactggtatttatagtttactttgaatatttatattaataattagctcataatttttattgcaaggctcaatgactgtcattggaatataattttgttcagtacaaagatacttgtagctgtctgtgatttacgagttaggcactacatctccattttcagactgaggggtggcaggcttcacatacagtgggaatggagtaattacaggagggagttgtaggagctttgaagtcagagagggaggtagaggcctttttacctagggcctcaaaggccattggaattttacttttattctgagataggaatctgttggaaggatttgaacaggtgattgaatatgttaggaactttgaggctgagttgagcttctgagatgattgaatgttggaatgaatctgttgtgtaagtaagagaataccaatttggcaggaagagaacatattctgcatccctcactgaattcagtaataaataaaaatgtgtacatgtgattaaaagaaggtgaa

SEQ ID NO: 27445 - DNA, 6339 bp, Homo sapiens
ggtcttctcagcgcagtcgggcgcggacccgctggtcccgggcagcggccaaggctactggggcgggagcagtgggccggtcggcggcggcagcggcagcggcggaggaggaggaggctggagtgggcgcggaggcgaccgccatggcgttcctcaaactccgtgaccagccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggattttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaa

SEQ ID NO: 27446 - DNA, 2293 bp, Homo sapiens
agcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtgtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtggcatagaagatgtggactacaatggaaaccttccagttcacttagcagccatggaaggccaccttcactgtttcaaattcctagtcagtagaatgagcagtgcgacgcaagttttaaaagctttcaatgataatggagaaaatgtactggatttggcccagaggttcttcaagcagaacattttacagtttatccagggggctgagtatgaaggaaaagacctagaggatcaggaaactttagcatttccaggtcatgtggctgcctttaagggtgatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggttggtgtcctttttaatacatttatttttctcaagaagtatatacaagagtggccaagagtacaagctttgggctggggctctttggacttgaatcctggctatagtctttttttgatttgggctactcatttaacctttttgtgcctcaactataaactggagatgataacttatactttctagagctgatgacaggattaaaggaatacacacacacacacacacacacacacacactctatatgtaactataactttctagatacatacacacatctgtctatctatcttcaaacagcagcctagttcataagtattattgttaacattgtaccatagaaggagaaaatgttttcataagtaatcaatcagaattctaagacagctagaggatatgtatattttaatattctaaataaccaaaataaagtgctttgaatggaatccatattttctttccatagggaagtttcttcatcaatcatcatggatgaattaattctgtttgaggcttgtgtcacctcaaatctgatctattaatattatagaatcttcctggcttctttttattttgcacaaactagtcattggtctctttaataaccactttaaaaatattaaaataataaaacatgtttgttgtatagtgttaaaaacaagatagatgttccttctgacactaagttccactctccagaggaagctattgttaacaatttagtacataccatattagacaaaattctatttatctgcaaacatgtatgtgtatttctatgcatatgcaaatataaccacttcctcagtttctctgggttttggtgtctcaccagtggttgattttccaagaaatataattaactataataatt

SEQ ID NO: 27447 - DNA, 3839 bp, Homo sapiens
ccccgccccctgcgctcacctgcccgcgcgctcgccttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagtcccatgaagtgggcaccattgctattgccagttcacagatgcagaaactgaggtaaaaactagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgctttgcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaaggggtagtggaaatagttcgaggcatattggaaagaggaggtgaagtgaatgcatttgacaacgacaggcatcacgctgctcattttgctgctaaaggaggctttttcgatatattgaagcttctttttgcctacaatggagacgtggggctgatttcgataaatgggaacacaccacttcattatgctgccatgggtggttttgcagactgctgtaaatatatagctcagcgaggatgtgacctgaaatggaagaatttagatcataaaacgcccagggctgtggctaaggaaggcggcttcaaagcagcaagcaaagaaatacgccgagcagagagaatcgctaataaactagccaggccaggagccaaaaatccaaatccactgtgggcccttagactgcacgattggtccgtagaacgtgaggctttcctccgggaagcctttgcggttttagacaggggtgatggaagcatcagcaagaacgacttcgtgatggtgttggaggaaaggcaggattatgcaagctcagaacagctggctgccatcgctcaccttcatgagaaaacccggggaggaggggtcaatattaatgaattctttaaaggaaccagatatttaaacaagtcttttgtcttaggatcgtatggacctaagaaaaaggaaaaagggatgggcaaaaaaggaaagaaagggaaatttgtcttaccccttccaatctgtgtcattcctgagtacgcgtttccacgccggcaggatggtgggccaccgtattacatgattgagacctacaagaatgtcactgatagcagccggtttaatagagatcatcccccagaacatcccattcaggatgactctgtttggtacattgatgattcagagaaggtattttcaaacattaatattatcaccaaagcaggggatctggcttctctgaaaaaggcctttgaatcaggaatacctgtggatatgaaggataattattacaaaactccgctaatgacggcgtgtgcaagtggaaacatagatgtggtcaagtttcttcttgaaaaaggagctaacgttaatgcaacagataactttctgtggactccacttcattttgcatgccatgcaggccaacaagacattgttgagcttcttgttgaatctggagctttaatagatgcagcttcaatcaacaactcaactcctttaaatagagccattgaaagctgcagactggatacagtaaaatacctacttgatattggtgctaaattccagctggaaaatagaaaagggcatagtgccatggacgttgcaaaggcatatgctgattatagaataattgatctgattaaagaaaagctagataacttgccgaaaccagcagaaaatcaaaaactaaaaggcaagacacctcctatactgaagactgaaggccctgaaattaagaaagaagaggaactgctgtcatcaatttatggtgtaccaaccacatcagagggaaagaaagtacagaagggtaatgtggttcatctgaattcattgattaccagtggttatactaagaaagtggatatcacatttattccacggaggatttggagtcctgaagccacaacagcagagctgatcaggaagagggaactacggcgagagaggtttacacatgaggtggacttcgacgattttatgatgccttttcagaagaacatcacagagaaagctcgagcactggaagctgccttgaagacctaagtcatagcagttatttcttggggtaaatgctttgaggcccagggaccaatctttggagaaagtagatatttccatcaaagccaaagcaatccatacaccaagaacttgttaccaagaatttctttttgctttaacaactataaatattcttagctgtctagagaaaagatgtatgttattttgaaatgaatggtatgtcattctggataaatccccaagcccctttatgaatgtagtgaaatacatggcatgtgggttataaacgttgctgtcaaaagatttaccaggtctacaccattatgcttattatttttttaattatcctttttatttattaaatagagacagagtctcactatattgccccagctggtctcgaactcttgagctcaggcagtcctcccaacttggccgtcgaaagtgctgggattataggcatgagctactgtgcccagcctgcttattgaagatacatttctagtggaaattgatgaaacaatttaggttttggaaaaagaagtaatatttaatcttttaaggaaggagtttatttctcacatgccattataaactatgtgtattagataccttgggttgaatacacttttaacagccctagatcgatagccctagccctagatagatagccctagccctagatagatagctattaggttggtgcaaaagtaattgtggtttttgccataacctttaattgcagcaaaaactgcaattacttttgctccaacctgacagctaggtatctagctagctagaaaggcagatagacagatatatagatgatagatagatagatgatagatagatagatagatgatagatagatagatagatagatagatagatagatagatagagatttattgcaaataattggtttacataattttgggccccagatggttaagtgctaaatttgtagggtaggctatcaggaagtgcaggctggaaacatgcaggagctgtccctgaagtccacaagtggaatttcttcttcatcatggaaacctcagttttgttcatacacctaaatacttcagtatgtctttcctaaaataaaaggcatccatttacctaaaaaaaaaaaaaaaaaa

SEQ ID NO: 27448 - DNA, 3775 bp, Homo sapiens
ccccgccccctgcgctcacctgcccgcgcgctcgccttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgctttgcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaaggggtagtggaaatagttcgaggcatattggaaagaggaggtgaagtgaatgcatttgacaacgacaggcatcacgctgctcattttgctgctaaaggaggctttttcgatatattgaagcttctttttgcctacaatggagacgtggggctgatttcgataaatgggaacacaccacttcattatgctgccatgggtggttttgcagactgctgtaaatatatagctcagcgaggatgtgacctgaaatggaagaatttagatcataaaacgcccagggctgtggctaaggaaggcggcttcaaagcagcaagcaaagaaatacgccgagcagagagaatcgctaataaactagccaggccaggagccaaaaatccaaatccactgtgggcccttagactgcacgattggtccgtagaacgtgaggctttcctccgggaagcctttgcggttttagacaggggtgatggaagcatcagcaagaacgacttcgtgatggtgttggaggaaaggcaggattatgcaagctcagaacagctggctgccatcgctcaccttcatgagaaaacccggggaggaggggtcaatattaatgaattctttaaaggaaccagatatttaaacaagtcttttgtcttaggatcgtatggacctaagaaaaaggaaaaagggatgggcaaaaaaggaaagaaagggaaatttgtcttaccccttccaatctgtgtcattcctgagtacgcgtttccacgccggcaggatggtgggccaccgtattacatgattgagacctacaagaatgtcactgatagcagccggtttaatagagatcatcccccagaacatcccattcaggatgactctgtttggtacattgatgattcagagaaggtattttcaaacattaatattatcaccaaagcaggggatctggcttctctgaaaaaggcctttgaatcaggaatacctgtggatatgaaggataattattacaaaactccgctaatgacggcgtgtgcaagtggaaacatagatgtggtcaagtttcttcttgaaaaaggagctaacgttaatgcaacagataactttctgtggactccacttcattttgcatgccatgcaggccaacaagacattgttgagcttcttgttgaatctggagctttaatagatgcagcttcaatcaacaactcaactcctttaaatagagccattgaaagctgcagactggatacagtaaaatacctacttgatattggtgctaaattccagctggaaaatagaaaagggcatagtgccatggacgttgcaaaggcatatgctgattatagaataattgatctgattaaagaaaagctagataacttgccgaaaccagcagaaaatcaaaaactaaaaggcaagacacctcctatactgaagactgaaggccctgaaattaagaaagaagaggaactgctgtcatcaatttatggtgtaccaaccacatcagagggaaagaaagtacagaagggtaatgtggttcatctgaattcattgattaccagtggttatactaagaaagtggatatcacatttattccacggaggatttggagtcctgaagccacaacagcagagctgatcaggaagagggaactacggcgagagaggtttacacatgaggtggacttcgacgattttatgatgccttttcagaagaacatcacagagaaagctcgagcactggaagctgccttgaagacctaagtcatagcagttatttcttggggtaaatgctttgaggcccagggaccaatctttggagaaagtagatatttccatcaaagccaaagcaatccatacaccaagaacttgttaccaagaatttctttttgctttaacaactataaatattcttagctgtctagagaaaagatgtatgttattttgaaatgaatggtatgtcattctggataaatccccaagcccctttatgaatgtagtgaaatacatggcatgtgggttataaacgttgctgtcaaaagatttaccaggtctacaccattatgcttattatttttttaattatcctttttatttattaaatagagacagagtctcactatattgccccagctggtctcgaactcttgagctcaggcagtcctcccaacttggccgtcgaaagtgctgggattataggcatgagctactgtgcccagcctgcttattgaagatacatttctagtggaaattgatgaaacaatttaggttttggaaaaagaagtaatatttaatcttttaaggaaggagtttatttctcacatgccattataaactatgtgtattagataccttgggttgaatacacttttaacagccctagatcgatagccctagccctagatagatagccctagccctagatagatagctattaggttggtgcaaaagtaattgtggtttttgccataacctttaattgcagcaaaaactgcaattacttttgctccaacctgacagctaggtatctagctagctagaaaggcagatagacagatatatagatgatagatagatagatgatagatagatagatagatgatagatagatagatagatagatagatagatagatagatagagatttattgcaaataattggtttacataattttgggccccagatggttaagtgctaaatttgtagggtaggctatcaggaagtgcaggctggaaacatgcaggagctgtccctgaagtccacaagtggaatttcttcttcatcatggaaacctcagttttgttcatacacctaaatacttcagtatgtctttcctaaaataaaaggcatccatttacctaaaaaaaaaaaaaaaaaa

SEQ ID NO: 27449 - DNA, 1714 bp, Homo sapiens
cttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatg

SEQ ID NO: 27450 - DNA, 4431 bp, Homo sapiens
ctgcgctcccgctccagctaggactctctctgccgcctcctcctcctcctccgacctcagtcctcaccaccctcctcccgctcctcaaaagcacccccgagtccccaccccctcacgccgcacccgcgggaacgaggccttgggaattcaggggagtggctgtgggggcgcgtcgcggctcccagctcggccagcccctctttcaagacatggtctgatccccattgtaaaagctgcgccccgaagaggaggagagagtcgtgctccctgcctggggctgcagggagctctccgtgctgaagctcttgcattattttagggtggggcgaagagggccctggattttggggagtgggggtgggtggggaggaggacccgaggggggcaaggactctgtgggggagtcggtgagagactatggggaaggaccaggagctgctggaagctgctcgcactggaaatgtggctctggtggagaaactcctgtctggcaggaaaggagggatcctgggcggtggatccggacccctgcccctgtctaatctgctaagcatctggcgaggccccaatgtgaactgcacagacagttcgggttacactgctttacaccacgcagccttaaatggacataaggacatagttctcaaactacttcagtatgaggcatcaacaaatgtagcagacaacaaagggtattttcctattcacctggctgcctggaaaggagatgtggaaattgtgaagattcttattcatcatggaccatcacattccagggtcaatgaacagaacaatgaaaatgaaactgccctacactgtgcagctcaatatggacactcagaagtagttgctgttctcctagaagagctcactgacccgacaattagaaatagcaagctggaaacacctttggacttggcggcactctacggacggcttagagtggtaaaaatgatcatcagtgcacatcctaacttaatgagctgcaacactcgcaagcacacgccacttcaccttgctgcgcgcaatggccacaaagcagtcgtgcaggtgctgctggaggcaggaatggatgtgagctgtcaaacagaaaaggggagtgcacttcatgaagcagctttgtttggaaaggtggatgttgtacgagttctgttagaaacaggaattgatgccaacataaaggatagcttaggtagaactgtcttggacattctgaaagaacatccatctcagaaatctctccagattgcaacactcttacaagagtatttagaaggcgtgggaagatctacagtcctcgaagagcctgtacaggaagatgcaacacaagaaacacacatttcatctcctgttgagtctccttcccaaaagaccaaaagtgaaaccgtcactggagaattatcaaaactcttggatgaaataaaactctgtcaagaaaaggattattcgtttgaagacttgtgccacacaatatcagaccactacttagataatttgagcaagatttcagaggaagaacttgggaaaaatggaagccagagtgtaagaacctcatctacaatcaatttgtcaccaggagaagtggaagaagaggatgatgatgaaaatacgtgtgggccatcaggactttgggaagcattaactccgtgtaatggatgtaggaaccttggcttccccatgcttgcccaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatcccccaaaagaatatgatcctgggcaatttgcaggcctgctccatggatcctctccagcctgtgagtcccctgaaaatccatttcatctctatgggaaaagagaacaatgtgaaaaaggacaagatgaagtcagtttggcaaacagtcctttgcctttcaagcagtctccaatagaaaataactcagaacctttggtaaagaaaattaaacccaaagtggtcagtagaacaatttttcacaaaaaaagcaaccaactcgaaaaccataccattgttggcacaagatcaaccaggagtggatctcggaatggggaccagtgggttatgaacgcagggggatttgtggagagagcctgtactctggggagaataaggtcattgcctaaagccttgatcgacatgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggtgagaccacaagacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatg

SEQ ID NO: 27451 - DNA, 1982 bp, Homo sapiens
gcagaggaggagcgcacgccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctaagatgtacttggatttaattaaaaagttcactttgt

SEQ ID NO: 27452 - DNA, 2665 bp, Homo sapiens
agtgttcttagaggtagccacacctcagcaagggctttctaacttggaacagcaaagttcaaatgaacgaatagacacaaactgtgaaagagtcctgaacccattacaaggtgaatctttacagcacaattgccttctgaagctacttgaaacagggcatgggacttaaaggagaaaaaaaaggaaatggaccatctcttctaacacctggaatgtgatccaagcctggagacaaattgatggtttgcagctagaagacagtaaatctagcaatggagcccatatatgaggagtacctagcaaatcatggaacaatagtaaaaccatattactggctaagcttctctctcgattgctctaattgtccttaccatattcgaacaggtgaagaagcaagagtttccctcacagaattttgtcagatttttggattcccttatgggacaacatttcctcaaacaaaacacctcacattttatgaactaaaaacttcttctggtagcctggtgcaaaagggccatgctagcagttgcactgggaattatatccatccagaatcaatgctctttgaaatgaatggttatcttgactcagccatatacaataatgacagcatcaggcatatcattctgtattccaacaactccccttgtaatgaagctaaccactgctgcatcagcaaaatgtataatttcctgattacgtatccaggcatcactcttagtatttatttttctcagctctatcatactgagatggactttcctgcctcagcatggaaccgcgaagctctccggagcctggccagcttatggccgcgggttgttttgagtccaataagtggtgggatctggcattctgttctccacagctttataagtggtgtctcaggatcacatgtttttcagcccattttaactgggagagcactggctgacaggcacaacgcatatgaaatcaatgccataacaggcgtaaaaccttacttcactgatgttcttctccagacaaaaaggaatccaaacacaaaagctcaggaggctttagagagctaccccttaaacaatgcctttcctggacagttttttcaaatgccgagtggacaactccaacccaacctacctccagacctcagggctcctgttgtttttgtgctagtgcctctcagggacttaccaccaatgcatatgggccaaaacccaaataaacccaggaatatcgtaaggcacttaaatatgcctcaaatgtcattccaggaaaccaaggaccttggaaggcttcccactggaaggtcagtggagatagtggaaatcacagaacagtttgcaagtagcaaggaggcagatgaaaagaagaagaagaaagggaagaaataaaatctacattcctacagcatgaaaccaattaccaagggacttattagataggcaataaaaatctggaaactttctctctcagggctgagccaagatggagataaactgatgcactaaaagcaaaccttgaattatttaccatatcaactattataaagttacactattttaaacataatccaaaatgtttccataagcaacttgatctctctcctttattttgaaagtggcagtatcaaaatggaaccattagcagcttgctaatattttgatgcagaaaaggaatctcattattctattttactcacatcatctttccactacaaaagcccatggacaaaatagctacctaaatttgtttcggtaaaaaatttactgtaaaattgaaaaacagcctgaagctactgacattaagtgctgtttgcaggagcaaaccagtgattttctattaattgttaatcatggacagaagattttaggcagctcatttttttctaaagtgattcaaaatagttttgtgtgggaaaaagctcttctgctgattacatatagctataaagattaaaacctagccacctgctcagtttgatcttccccagctcagacctctcccttctgagcagatgatagaggtaagatgatacatgagaacctccaatggctcctgtcatcacatactgtataaaatccaagttcctcttactggctttcaaggatcctcctttaacttcctgttgccttgtctcatcagcaagatcataagtacctacaggtcaagcactgtctctcccttctctttagcttttcccttaggatctagcacattacccagcaaaatgtgagtagcaaggctgaaatgacatctcaataacttcaccaatgattgtaactcagcatcccttctccatcccagctgaaagcctgcttcaccatcctgcaagagatgttttttctttttgttagcatccattcccctttctaatgcagctcccaatgcataatgtgtgttttacttccctctttctgactccatcctcgtcaccagtgaatatttgtaccttctcttaaaatcttcaaaacacacttctaggaagtgctccttgattaatcctctaagcacttaaatgaaagcactttgcttatgcttatttcacatttgctgccacttgcctctttgaaatatgtaaagatacattacaagaaaaatgtacattttctcgtaacttgctattaatttttttctttatatatatatataaagtaatcctaagccaaaaaaaaaaaaaaaa

SEQ ID NO: 27453 - DNA, 5482 bp, Homo sapiens
agtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagtcatggttcatcagaatgtattaagattcagaaccaaaggttatatgaaattggaggaaatataggagagcattgcttggatccagatgcttatatattggatgtatatcgtataaatcctcaagcagaatgggtgattaaaccccaacaaagttcttaaaatatcctcgagagagctgctatcatgtattatatgccaaaaagatcctacattttggtagggaaaaaacaacactgtgtttgacgtatttgttcctacagcattctcagtatttctggccctcagcagtgggcattgtaagcatgaactatggaagaggcgccggttcaccaattcaactgaagctttctcatgacttttttttttataaaagtaaaggaaagatgatgtggtccttccagaagaaagaccaatctagaatatggaactctaatcacttctagtatttcaacttcctagcagaaatgaacttggccctagacctagggataagcaatgttctttatgtagccaatgctacgaaacaaaagaggtgaaagagacccttttttatacttaatgtacatatattgactttttgagcaagaatgccagaaatagccttcatttctaccctgcaaaataatccagatctgctttctaaaatgaatcagtttctaaagtgaaacatgcaatatttatgctctgactgactcctgaattggaagaggaagaacttctgtttacagaaaactgtattgttatatatgtcaggctgtgtattgtgactatcagcattctggtgcaaatgaacttttctccatcatcgactgtggaaaattgatacttttaaagcatattcttctatgagcacaggtcctcctagtgaagcttagtttgacaaagggtgtcatatgctttcctaacctgatttgtagttaacattcacagagcctacattttctcattacggttatgatgctcagtatctttccaagtgccaggcacgggcttccttttctgatcaaacataccattttttatatttcacaactatagacagtcacttctgcagtcccaatttaaaaatgcagaactgctttatccaagaatgctgaaaaatactgttctatccaggtttcctaaactataaaagcagattttgcttttgtttgttaatcataggcatggccgagcattgtggattagcctgaggcttaaaatcagatgcatgtctggtaagatgaccactgtctcactatcaagagcctgcagagccattttccagacctgtgattgcccagaacacatagtccccacgtttctaatttggagcaaatctaaaaggtgctgagggattggacagctctgactttcctcgagactatggatatagtccttctcagattagctggaaatggggacagagttctcatttatcccagatatatacattggcttttttggaatctatagattgagattttgatgaatttatattggttttaatgagacccaaatgactctctcttaacaattcaagcagtagacaaagttgctcacaaatacagaaaacatctttttgtctacttcgcaagtctcaaaacgtgataatatttaagcccatttgtagaagaaatcttgtatatactattattacaccttgatatctatacaaaacatcacttgtattaaaatatatagataactttctggcatttagaattttgttccattcatttaatttgttcatctgagaatttttttttttgcctgaaaacccattaaaagaaaacgtgccttctgtataagtttatgtttattcctacattttattcatttttaatgtatgggtaattggtggcacatgactttacataatgactttctagactctgaaaaaaatgcttttatcatttttgcaattcagacaagggtaaacattttactttatgtaattgccacatcccaagatgtaaaacggcagtaatttatgaccacgtatggaagaaattcttcaaatagctaccttacatttctgcgtatatatgaaaactgaatgatatttctcagtgtatttccttgcatttgaatggttcaattctgttgtgtttatgtagaaaattcacaaatctgttcatttaattttttaatttgagaatttttatttcttttgactgaaaacacattagaacctatgagtaaattctgaaggttttaagatttacttcagcttgtcaccagtttcaaataaatccctaataggtaacaagtaaaatacaaattcttgtctactttcatgtggttttaaatggcagggacttcgctgagtcagtaagtataatcactctagtttattcaaggatgtgtggcaactttcaacttccatacgtatatatgtatgtatggaaggccatgtcaatactagtatcattggatataactttgattcttaatcagagggcaaattcattagagaagaatttttagtagatacacagactaatatttgtgtggaggttcttttgaccaattttattcctaagaataaacaaacccctacagttaaaatgcaaagatgcctgtcatctaagtattgaaagaatttttgccttatcaagagttgttttttaaaaatttaataaattcataaaaaagactcatatctttgcaaacaaaagaagggcagatactgggcttctacatgctatccttaagagcttctccccctcacccattcctagtgctcttggtatacacttgggaaaataatgtcctccaggagaaagtgttagagggaactaacattttaggaatgcttattcagaaaaaaatcctagagttgattcattgttttcctccatcctgcaaaagaagatccctttgttaagcagctcacttggaaatatgattcttggagtcaatgatctctaaacaaactggattatcaactatttacaacgtctatacagtataaactacctcacttgcctttcttgggaaaaaaaaaatgaatggactttaacaattgttgttacaaactgtgcctgaatcttattatttaaatcacttcagttagctttcagtgtatgtttaataatatacatttaatgatgaaaaatattttcagcaaagctttaaaaccagaaatactgtgtaactgtgatctatgtggtatactctgagagaattctgtgtcctgctcattgtcttgagtttctaaccatgtgcagatgcaagcgttcaggagtaggaattaatgtccatcttttctttcaggcattttcatctgctgtccacgtatttcacttgactgaaagctcatatgagttaaaatgtcccttcttcctagcgagcatatttcaactgttcttcataaatgtttatgtgccttaaaagactttatgttaaaggattaaatagtttctctgacaggcagtttttaactgttttccacaaataaaaataatatgtcatgggattaaaatgtttgttttcaagcatttttaacagttttacacacttacatacaccttaattaaaaatttttttctgtcagacatttaccaactattttctaaaactaatttgacaaatcatgacactagaaaacgccaatgttttatgtctttgcccatctcaaaagctaatattgattcttctgttccatcagctttcattgttaagtagaatatgtatgttgcattttatccataagaaataaagagaaaaaaactaaaaa

SEQ ID NO: 27454 - DNA, 1002 bp, Homo sapiens
agctcaatgcgtcttcctattactctgcatatcttatgtcttccatccaaaaagaatcaacttatcagataaataaccacctcatgaactaagatgaatcatgttccggcttttgtcctcctgctgctcttgcctaaggacaacagaagagacacgaaggaatgtgaccatccctatcattggcttgaacaactctggcaaaactgttcttgtggaggcattccaaaaattacttcccagtaagacagaccattgcatgaaatcggaactgactacacttttgttagatgagtatgaactttccatctatgacctgaatggagacctgaagggccgggaagcatggccaaactactatgcacaggcccatgggcttgttttcgtcctggattccagtgacataagacgcatgcaggaagtgaagatcatcttaacacatctgctgtccgataaaagagtggcagggaaacccatcttaattttagcaaacaaacaagacaagaagaaagccctcatgccttgtgatattattgactatctacttctaaagaagctagtgaaagagaataagtgcccatgccgagtagagccatgttcagccatcagaaaccttgaaagaagaaaccatcagcccatagttgaaggactgcgctggctattagctgtcattgatacttgccaactaccacctacctcgagcatctcaatctccaagaataacacaggctctggagaaagatgctcatcacacagcttctccaccagaacaggaatgtcaaaggagaaaagacagcatctagaacaatgctcaatcgaagctaagcctctaaagtcaatcctacagattctagccatcaaatcaatcctatactcactgagaggctcaagaagagtgagatggcatccattgagaatgaagaccaccttggtaaaaaagaacagagactttacatctttgtaccgagatgctgctgacaaagcttgtggacaataagtcatggg

SEQ ID NO: 27455 - DNA, 2100 bp, Homo sapiens
agtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctc

SEQ ID NO: 27456 - DNA, 3277 bp, Homo sapiens
agtggccgagcggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggggaccaggggaagagacatgcgagggcctcatcatgccccagtagctcagacctgagcaggctgcaaaccaaagcagtcccaaaagctgacctgcaagaagaggacgcagaaatagaagtagacgaagtcttttggaatacaaggattgtaccgattttgcgtgaattagaaaaggaagaaaacattgaaacggtttgtgctgcttgcacacaacttcatcatgctttagaggaaggaaacatgcttggaaataaatttaagggaagaagtattctcctgaagaccctgtgtaaactagttgatgttggttcagactcgctcagccttaaacttgcaaaaataattctagcacttaaagtgagtagaaagaatcttcttaatgtctgcaaacttatatttaaaattagcaggaatgagaagaatgattctttgattcaaaatgacagcattctggaatcattattggaggtactaagaagtgaagacctgcaaactaacatggaagcttttttatactgtatggggtctataaagttcatttctggaaatctgggatttcttaatgaaatgatcagcaaaggtgctgtggaaatactgataaatttgataaaacaaataaatgaggacatcaagaaatgtggtacatttttgcctaattcgggccacttgctagtccaggtgactgctacattgagaaacttggttgattcatcattagtaagaagtaagttcctaaacatcagtgcccttccccagctctgcacggcaatggaacagtacaagggtgacaaggacgtctgtaccaatattgccagaatattcagcaaacttacttcttaccgtgactgctgcacagccttggccagctattccagatgttatgccttatttctgaatctaattaacaaataccagaagaagcaggatttagtcgtccgtgttgtttttattcttggcaacctgacggcaaaaaataaccaggctcgtgaacaattttccaaagagaaagggagcatccaaactctgctgtcattattccagacgttccatcagctggatctgcattcccagaagccggtgggccaacgaggcgagcagcacagggcgcagaggccgccgtcagaggcagaggacgtgctcatcaagctgactcgtgtgctggccaacattgccatccacccgggcgtgggcccggtgctggccgccaacccggggatagtgggcctgctcctgaccacgctggaatacaagtcacttgatgattgtgaggagctggtgatcaatgctacagcgacaatcaacaatttatcttactaccaagtgaagaattccataattcaagacaaaaagctatatattgctgaattgctcttaaagcttcttgtcagtaacaacatggatggaatcctggaggctgtgcgtgttttcggaaatctctcccaggaccatgatgtctgcgatttcattgtgcagaacaatgtccacaggttcatgatggcgctgctggatgctcagcatcaggatatctgcttttctgcctgtggtgttctcctcaatctcactgtggataaagacaagcgtgtcatcttgaaagaaggaggtggcattaaaaagttagtggactgtttaagagatttgggtcctactgattggcagctggcctgcttggtttgtaaaactttatggaacttcagtgaaaacatcactaatgcttcgtcatgttttggaaatgaagacaccaacacactcttactcttgctctcatcatttttagatgaagaactagcactggatggcagttttgatccagacctaaaaaactatcacaaactccattgggaaacagaattcaaacctgtggcacagcagcttctaaaccgaattcagagacatcacaccttcctggaacccctgcccattccctctttctaacatgatgcagattaacagtagaaacgagaactcacgtctccctcattcttaagaactggtaacaaacgtgaacatttttttcagcattaacaaatgtggaaagtttttcaagaactggttttagtgagtagctgaagtattttttaaaattaagcatttcttcttgttaggtattatggaaaaatgaatatacacattatatttcctgttgagagaaatgtaagatgaaaatatgtgcattttcaagtaaatgactttttcttctattctctattaaacaatttagttctagtcttaaaatcttgatttaacaattttggaattgaagtgttcataagttaaatgaactgtgcaatgaaggctgttagattatatagaaagaagggtaggcaacatgagtggaacacgttacaacataggatctgtactaattcttactatgtcaaataataaatgctctcattaggaaaaaaaaaaaaaaaaaaaaataaaaaaaaaaaaaaaa

SEQ ID NO: 27457 - DNA, 2831 bp, Homo sapiens
gaggcacaacaagggactgggggttcgtctgctgggtttgcggagcagctagctactcggcgggatctcccggcaggatgggtaaaaagataaagaaggaagtagagcctcctcctaaggatgtgtttgacccattaatgattgaaagcaaaaaagcagcaactgtggtgttaatgcttaattctccagaagaggaaattttggctaaagcatgtgaagccatttataaatttgctttaaaaggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaagaagaagtagttatccatgagtttgctagtctttgtctagcaaacatgtctgcagagtacaccagtaaagtgcaaatatttgaacatgggggattagagccactcatcagactactgagtagccctgacccggatgtaaagaagaactctatggaatgcatttacaacttggtgcaggattttcagtgtcgagctaaacttcaagaactaaatgcaatacctcctatcttagatctcttgaagtcagaatatccagtgattcagttgttggctctcaaaaccttaggtgttattgcaaatgataaggagtctcgaacaatgctaagagacaatcaaggattggaccatcttattaagatcctagaaactaaggaattgaatgaccttcatatagaagcacttgcagtgatagccaattgccttgaagacatggatactatggtgcagattcagcagacagggggtcttaaaaagctcctgtcatttgcagaaaactctacaattcctgatattcagaagaatgcagcaaaagccattactaaagcagcttatgatcctgaaaatagaaaactttttcatgaacaagaggttgaaaagtgccttgtagcccttttgggttctgaaaatgatggaactaaaattgctgcttcccaagctatttcagcaatgtgtgagaattcaggcagcaaagattttttcaataatcaggggattccacagttaattcagttgctaaaaagtgacaatgaagaggtacgggaagcagcagctctagccctggcaaacctaaccacttgcaaccctgctaatgcaaacgctgctgctgaagctgatggtattgatccattaataaacctcctgtctagtaaacgagatggagccattgccaacgctgctacagtattaacaaacatggccatgcaggagcccctgcgcctgaacatacagaatcacgacatcatgcatgccatcatcagcccactgcgttctgcaaacacagtcgtgcagagcaaagctgctctcgctgtcaccgcaactgcgtgtgacgttgaagcccggactgagttaagaaattctggtggattggagcccctggtagagctgctacgctccaagaatgatgaagtgaggaagcacgccagttgggcagtgatggtctgtgctggtgacgagctgacggccaatgaattatgcaggctcggggctttagatatccttgaagaagttaacgtatcaggaactcggaaaaataaattcagtgaggcagcttataataagttgctcaataacaatctttccctgaaatacagccagactggctatttgtcatcaagtaacataattaacgatggattctatgattatggtcggataaatcccggcaccaaactgttgcctttgaaggagctctgcttacaagaaccaagtgacctacgggctgtactcttaatcaacagtaaatcttacgtttctccaccttcatctatggaagataaatcagatgttggttatggacaaagtatttcttcttcatcttccttaagaagatcaagtaaagaaaagaacaaaaaaaatagttatcattttagtgctggatttggatctcccatagaagacaaatcagagccagcttctggacgaaatactgttctcagcaaaagcgccaccaaagaaaaaggatggaggaaaagcaaaggaaaaaaagaagaggaaaaagtgaaagaggaggaagaggttatggtggtaccaaaatttgttggtgaaggaagctctgacaaagaatggtgtcctccctctgaccctgatttctctatgtatgtgtatgaggtgaccaaatcaatactgccaataaccaatattaaggaacagattgaggatctggcaaagtatgtagcagaaaaaatgggtggtaagattccaaaagagaaactacctgatttcagctgggaacttcacataagtgaactgaaatttcaacttaaatccaatgttataccgattggacatgtcaaaaaaggaatcttctaccatcgagctttgcttttcaaggctctggctgatagaattggcattggttgctccctagttcgcggagagtacggtagagcgtggaatgaagtcatgctgcagaatgactctcggaagggagtgattgggggcctccccgctcctgagatgtacgtgattgacctcatgttccatccaggtggactgatgaagttgagaagtcgagaggctgatctttacagattcatttaagccatcagacgaacacaagagaggctcaaacaagaaattcactgtgtacactctctaagacattctccaaattgattttatctctttaaataaaaactttaaataagaaaaaaaaaaaaaaaaaaaaaaaaaaaa

SEQ ID NO: 27458 - DNA, 2002 bp, Homo sapiens
aagaattccgtggctttggaaaataaaactgctgttatagctcttctgggtatttgagaaatgcacttgtgaagggttagagttgaatcttttgatgcgaaagtcgggttttcctgatactgggattccgggattccaggtgttggggtggcccaattcctgcgagaagcaatagcgggcggtaacatgaggagcacggtgcgtccagcgagtccttccgcctggggccctgccgaccccctgcctgcgcccccaggactctggcctcacccggccgtgccggggcctctgtgacgcggcgttccaggcactcggccccggccgagcccgtagctagagcggctcagagacaggaggcggcggcagcagcggcggcatgaaccactgccagctaccggtggtgatcgacaacggctcgggaatgatcaaggcgggcgtggctgggtgccgggagccccagtttatctacccgaacattatcggccgcgccaagggccagagccgcgcggcccagggcgggctagaactctgcgtgggcgaccaagctcaggactggaggagctcgctgttcatcagttacccagtggagcgtggtctcattacttcatgggaggacatggagatcatgtggaagcatatctatgactataacctaaagctgaagccgtgtgatggcccagtcttgattactgagccagcgctgaacccactggccaaccggcaacagatcacggaaatgttttttgagcatctgggtgttcctgccttctatatgtccatccaggctgtgctggctctctttgctgctggcttcactactggccttgtgctgaattcaggtgctggggttacccagagtgtgcccatctttgagggttactgtctgcctcatggtgtgcagcaactggatctggcaggccttgacctcaccaactacctcatggtgctaatgaagaaccatggtatcatgttgctcagtgcttcagacagaaagattgttgaagacatcaaggagagcttttgttatgtggcaatgaactacgaagaggaaatggccaagaaacccgattgtctagagaaagtttaccaactacctgatgggaaggtcatccagctccatgaccagctcttttcttgtccagaggccctcttctctccgtgtcatatgaaccttgaggcccctggcattgataagatatgcttcagcagcataatgaaacgtgatacaggcctgaggaattccttcttttccaatattatccttgccgggggatcaacctctttccctggtttagacaagcggttagttaaggatatagcaaaggtggctcctgccaacaccgctgtgcaagttatagctcctccagaaaggaaaatatcagtgtggatgggaggttctattcttgcatccttgtctgccttccaggacatgtggatcactgctgcagaatttaaagaagttggacccaacatagtacaccaaagatgcttctgaaatacagataaaatggttggaagaaaatgttttgagtatatgtgacagaaaactttggatattatatgtttctgggagaagagaaaatacttcacctattgggatgccaatatttctgttgtatttctataatgggtttgggggataataatggtgaagctcaagaacagatgtctattgagtagaaccaagttaaaataatgtttcccatagtgtttcttctataacttgacgttggtgagcttatatttcccttggaagagagcatttgtggtacaatatgctatgtgccaaatgagtgataagatttaagcttattgaagtttagggaaagaaggttgctgtggtgaggaacgagactccatagcagaggtatgccatcatggaaggggtggcattgggatggagcgcagatatccaggcaagcatactaaaatgaacaagttgctaaagatgagaatgaacaaagcatattcagggcatgtttaatagactgattttgttttt

SEQ ID NO: 27459 - DNA, 1556 bp, Homo sapiens
gactcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattaggtaaaaaaaaaaaaaaaaaaaaaaaaaaaaaa

SEQ ID NO: 27460 - DNA, 1105 bp, Homo sapiens
aatatttattttttctggttacagtttaaagggcacttctgtttgtggagtaaagcctgccacattgtcaaaatatgtaactggaggattacagtatgcttacctctgattttatttctacagtgctgctataagtaacaatgagtaaatctactaaattatgtggtaagacttcttgtccaagaagcaatatattctgcaatctccttgacaaaattgttaaaagaccctccctacagtttttgggtcagtggggatatcactgttacgaaccaaggatttacagatcactggcaaaaattctgaggtatgtggacttggatggttttgacgcactactcacagattacattgcatttgtggaaaaatcaggataccgttttgaagtaagttttaacctcgacttcactgaaatatgtgtgaatacaattctgtactgggtttttgccagaaaaggtaatcctgactttgtggaattgcttctcaagaagacaaaagactatgttcaagacagaagttgtaacctggcactgatatggagaactttcacaccagtatactgtccaagcccattaagtggcatcacacctctcttttatgtagctcagacaagacagtctaatatcttcaaaatactactgcaatatggaatcttagaaagagaaaaaaaccctatcaacattgtcttaacaatagtactctacccttcgagagtaagagtaatggttgatcgtgaattggctgacatccatgaagatgccaaaacatgtttggtactatgttccagagtgctttctgtcatttcagtcaaggaaataaagacacagctgagtttaggaagacatccaattatttcaaattggtttgattacattccttcaacaagatacaaagatccatgtgaactattacatctttgcagactaaccatcaggaatcaactattaaccaacaatatgctcccagatggaatattttcacttctaattcctgctcgtctacaaaactatctgaatttagaaatctaacatacgtcagtgtcctaagttccttaacaatgcttaccaatgtatggcttagaagttaataaaaattcactccatgt

SEQ ID NO: 27461 - DNA, 2359 bp, Homo sapiens
cgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcactttttttttttttttttttttttaaa

SEQ ID NO: 27462 - DNA, 951 bp, Homo sapiens
caccagcccagccagaagcaagtcccagcccccagccctcccctggcctaccttttggggcccttctctgaaccaggctcccctgtcctgcaactctgtcattcacagggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggccttttttgtcaccatcgtggttgtgcagtgggcggatctcatcatctccaagactcgccgcaactcacttttccagcagggcatgagaaacaaagtcttaatatttgggatcctggaggagacactcttggctgcatttctgtcctacactccaggcatggacgtggccctgcgaatgtacccactcaagataacctggtggctctgtgccattccctacagtattctcatcttcgtctatgatgaaatcagaaaactcctcatccgtcagcacccggatggctgggtggaaagggagacgtactactaaactcagcagatgaagagcttcatgtgacacaggggtgttgtgagagctgggatggggccagagattataagtttgacacaacatctgagacactaggatgaattatcttggatgagaaagatgggcaatcctgggctggcttgagggaatcatgggcagaggatgaggtgggctgaagggaagcccagcctgcatctagctggagccccgcagggaggggcatggtcctgctgaatcccgtagccagtctagacagtaaatgtctggaaaagccctcaaaaaaaaaaaaaaaaaaaaaaaaaaaaaaaaaaaaaaaaaaaaaaaaaaaaaaaaaaaaaaaaaa

SEQ ID NO: 27463 - DNA, 3873 bp, Homo sapiens
aaccacagggcctgggactggggggttcccagatccttgaagctcactccgcctcctcactctcactgcatttcccaccttcctgtgggccttgcggcatcttcatcactgaggcacctggttacgcttcacctcttgtttcctgccctcactgcattccctcacctctacctttttatccttccaccctaggcttctctcctccctcttccctcactcctgactcttcctcttcccagcggacggctggaggaccgctcagtctctcctctctcacttcccttcctctctctcaccttcaccacccaacacctccctccctgcctctttctttctgctccctcattctctccccaccactctcttctcgtggcccccttgcccgcgcgccctcttcccttccccttgcctcactctctcagctttcttcccacagttgagctcgggcagctctttctggggatagctatggggctttgggggaagaaagggacagtggctccccatgaccagagtccaagacgaagacctaaaaaagggcttatcaagaaaaaaatggtgaagagggaaaaacagaagcgcaatatggaggaactgaagaaggaagtggtcatggatgatcacaaattaaccttggaagagctgagcaccaagtactccgtggacctgacaaagggccatagccaccaaagggcaaaggaaatcctgactcgagatggacccaatactgttaccccaccccccaccactccagaatgggtcaaattctgtaagcaactgttcggaggcttctccctcctactatggactggggccattctctgctttgtggcctacagcatccagatatatttcaatgaggagcctaccaaagacaacctctacctgagcatcgtactgtccgtcgtggtcatcgtcactggctgcttctcctattatcaggaggccaagagctccaagatcatggagtcttttaagaacatggtgcctcagcaagctctggtaattcgaggaggagagaagatgcaaattaatgtacaagaggtggtgttgggagacctggtggaaatcaagggtggagaccgagtccctgctgacctccggcttatctctgcacaaggatgtaaggtggacaactcatccttgactggggagtcagaaccccagagccgctcccctgacttcacccatgagaaccctctggagacccgaaacatctgcttcttttccaccaactgtgtggaaggaaccgcccggggtattgtgattgctacgggagactccacagtgatgggcagaattgcctccctgacgtcaggcctggcggttggccagacacctatcgctgctgagatcgaacacttcatccatctgatcactgtggtggccgtcttccttggtgtcactttttttgcgctctcacttctcttgggctatggttggctggaggctatcatttttctcattggcatcattgtggccaatgtgcctgaggggctgttggccacagtcactgtgtgcctgaccctcacagccaagcgcatggcgcggaagaactgcctggtgaagaacctggaggcggtggagacgctgggctccacgtccaccatctgctcagacaagacgggcaccctcacccagaaccgcatgaccgtcgcccacatgtggtttgatatgaccgtgtatgaggccgacaccactgaagaacagactggaaaaacatttaccaagagctctgatacctggtttatgctggcccgaatcgctggcctctgcaaccgggctgactttaaggctaatcaggagatcctgcccattgctaagagggccacaacaggtgatgcttccgagtcagccctcctcaagttcatcgagcagtcttacagctctgtggcggagatgagagagaaaaaccccaaggtggcagagattccctttaattctaccaacaagtaccagatgtccatccaccttcgggaggacagctcccagacccacgtactgatgatgaagggtgctccggagaggatcttggagttttgttctacctttcttctgaatgggcaggagtactcaatgaacgatgaaatgaaggaagccttccaaaatgcctatttagaactgggaggtctgggggaacgtgtgctaggcttctgcttcttgaatctgcctagcagcttctccaagggattcccatttaatacagatgaaataaatttccccatggacaacctttgttttgtgggcctcatatccatgattgaccctccccgagctgcagtgcctgatgctgtgagcaagtgtcgcagtgcaggaattaaggtgatcatggtaacaggagatcatcccattacagctaaggccattgccaagggtgtgggcatcatctcagaaggcactgagacggcagaggaagtcgctgcccggcttaagatccctatcagcaaggtcgatgccagtgctgccaaagccattgtggtgcatggtgcagaactgaaggacatacagtccaagcagcttgatcagatcctccagaaccaccctgagatcgtgtttgctcggacctcccctcagcagaagctcatcattgtcgagggatgtcagaggctgggagccgttgtggccgtgacaggtgacggggtgaacgactcccctgcgctgaagaaggctgacattggcattgccatgggcatctctggctctgacgtctctaagcaggcagccgacatgatcctgctggatgacaactttgcctccatcgtcacgggggtggaggagggccgcctgatctttgacaacctgaagaaatccatcatgtacaccctgaccagcaacatccccgagatcacgcccttcctgatgttcatcatcctcggtatacccctgcctctgggaaccataaccatcctctgcattgatctcggcactgacatggtccctgccatctccttggcttatgagtcagctgaaagcgacatcatgaagaggcttccaaggaacccaaagacggataatctggtgaaccaccgtctcattggcatggcctatggacagattgggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggccttttttgtcaccatcgtggttgtgcagtgggcggatctcatcatctccaagactcgccgcaactcacttttccagcagggcatgagaaacaaagtcttaatatttgggatcctggaggagacactcttggctgcatttctgtcctacactccaggcatggacgtggccctgcgaatgtacccactcaagataacctggtggctctgtgccattccctacagtattctcatcttcgtctatgatgaaatcagaaaactcctcatccgtcagcacccggatggctgggtggaaagggagacgtactactaaactcagcagatgaagagcttcatgtgacacaggggtgttgtgagagctgggatggggccagagattataagtttgacacaacatctgagacactaggatgaattatcttggatgagaaagatgggcaatcctgggctggcttgagggaatcatgggcagaggatgaggtgggctgaagggaagcccagcctgcatctagctggagccccgcagggaggggcatggtcctgctgaatcccgtagccagtctagacagtaaatgtctggaaaagccaaaaaaaaaaaaaaaaaaaaaaaaaaaaaaaaaaaaaaaaa

SEQ ID NO: 27464 - DNA, 3389 bp, Homo sapiens
atgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactgggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaaaaaaaaaaaaaaaaaaaaa

SEQ ID NO: 27465 - DNA, 3514 bp, Homo sapiens
atgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaaaaaaaaaaaaaaaaaaaaa

SEQ ID NO: 27466 - DNA, 3484 bp, Homo sapiens
atgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaaaaaaaaaaaaaaaaaaaaa

SEQ ID NO: 27467 - DNA, 4753 bp, Homo sapiens
atgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaaaaaaaaaaaaaaa

SEQ ID NO: 27468 - DNA, 1261 bp, Homo sapiens
ccacggctgctcacgacgccgcggatcccgaagcctgtgtagcagtgagacatcagtgaggctgcaggacgagcaggattggaagcgccccggccagaaagtgaccccccacccctttcaggaccctgtgaacgggaacagccatccagagggttcaggaaggcgtccgcgccctcacctcttctccccatgagctcccccagagctgtggtgcagctgggcaaagctcaacctgcaggcgaagagttggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcataccaaaaaaaaaaaa

SEQ ID NO: 27469 - DNA, 1120 bp, Homo sapiens
ggaagtacctctctgagcggttggtgccgggtataaaagaaggccgcgcagccacggctgctcacgacgccgcggatcccgaagcctgtgtagcagtgagacatcatggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcataccaaaaaaaaaaaa

SEQ ID NO: 27470 - DNA, 1125 bp, Homo sapiens
ggaagtacctctctgagcggttggtgccgggtataaaagaaggccgcgcagccacggctgctcacgacgccgcggatcccgaagcctgtgtagcagtgagacatcagtgagtggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcataccaaaaaaaaaaaa

SEQ ID NO: 27471 - DNA, 3438 bp, Homo sapiens
atggggagcccccgggccgcgcggcccccgctgctcctgcgcccggtgaagctgctgcggaggcgcttccggctgctgctggcgctcgccgtggtgtctgtggggctctggactctgtatctggaactggtggcgtcggcccaggtcggcgggaaccccctgaaccggaggtacggcagctggagagaactggccaaggctctggccagcaggaacattccagctgtggatccacacctccagttctaccatccccagaggctgagcctcgaggaccacgacattgaccaaggggtgagcagtaacagcagctacttgaagtggaacaagcctgtcccctggctctcagagttccggggccgtgccaacctgcatgtgtttgaagactggtgtggcagctctatccagcagctcaggaggaacctgcatttcccactgtacccccatattcgcacaaccctgaggaagcttgctgtgtcccccaaatggaccaactatggcctccgcatctttggctacctgcacccctttactgatgggaaaatccagtttgccattgctgcagatgacaacgcggagttctggctgagcctcgatgaccaggtctcaggcctccagctgctggccagtgtgggcaagactggaaaggagtggaccgccccgggagagtttgggaaatttcggagccaaatttccaagccggtgagcctgtcagcctcccacaggtactacttcgaggtgctgcacaagcagaatgaggagggcaccgaccacgtggaagttgcatggcgacggaacgaccctggagccaagttcaccatcattgactccctctccctgtccctcttcacaaatgagacgttcctacagatggatgaggtgggccacatcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggttcagctttcaggagtacatcaagattgaccagcctgagaagcaggggctggagcagccaggttttgaggaaaaccttctagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggaggtaccagctacagcgcattgtgaacgtggaaaagcgtcaggaccagctacgtgggggtcgctacctcctggagcttgaactgttggaacaaggccagcgcgtggtgcggctctcggagtatgtgtctgcacgaggctggcagggcatcgatccagctggtggggaggaggtcgaggcccggaacctgcaaggcctggtctgggacccacacaaccgtaggagacaggtcctgaatacccgggcccaagagcccaagctgtgctggcctcagggtttctcctggagtcaccgagccgtggtccacttcgtcgtgcctgtgaagaaccaggcacgctgggtacagcaattcatcaaagacatggaaaacctgttccaggtcaccggtgacccacacttcaacatcgtcatcactgactatagcagtgaggacatggatgttgagatggcactgaagaggtccaagctgcggagctaccagtacgtgaagctaagtggaaactttgaacgctcagctggacttcaggctggcatagacctcgtgaaggacccgcacagcatcatcttcctctgtgacctccacatccacttcccagctggagtcatcgatgccattcggaagcactgtgtggagggaaagatggcctttgcccccatggtgatgaggctgcattgtggggccaccccccagtggcctgagggctactgggaggtgaatgggttcgggctgcttggcatctacaagtctgacctggacaggattgggggcatgaacaccaaggagttccgagaccgctggggcggggaagactgggagctgctggacaggatactccaagcgggcctggacgtggagcgtctctccctcaggaatttcttccatcatttccattccaagcgaggcatgtggagccgtcgccagatgaagacgctgtagccggagggtgtccgcggggcccagcactccccgctctggactagcagtggctccccagggccctgctactgttcagggatggggagtggggtgacggctggaccccaagaggcctcgaagctgacggcccactccacctggagctgtcccctcacagaggcaggttccggggctcctgtctctgcctcctgggccttcagaagggaggactttgagagagaggccaggagggaccacttgctcagtcgagaacgggaagagctcctgagaaggacgggtcaggaaggagagatctgactgagcgacaccatcctcatccatgaaggtgcacgcccacatcccccaagcgctcctcacgccaagcgctgaccaccagaccctcttctagtggacatattttattggggggcggggattttaaaaacagaaaaccgaaactgc

SEQ ID NO: 27472 - DNA, 5642 bp, Homo sapiens
cgcccgccgggcgctctcgcttcagtcagtcgggccgcgccgcgcctcagctctggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaaa

SEQ ID NO: 27473 - DNA, 5770 bp, Homo sapiens
gtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaaa

SEQ ID NO: 27474 - DNA, 4840 bp, Homo sapiens
cggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtgg

SEQ ID NO: 27475 - DNA, 5006 bp, Homo sapiens
ctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttgggtaaagggccaagagggaagggcgaggcggggaggaagcagctcgggccgccttccctccgtggcctccaggacatccgccggggatagattatgcgtttccattggttacccaccttgagcgagccgtttgatagaaaccaagagcttgaaacgtgcattaggccattgtggactcccagtgggagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtgg

SEQ ID NO: 27476 - DNA, 4847 bp, Homo sapiens
ggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttggtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtgg

SEQ ID NO: 27477 - DNA, 3196 bp, Homo sapiens
agagacgcagctaggcctgcacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagaggtagactcttggtaacaaatttaagaattctctggcactctttggcattatcaagagtcaatgtttctgtcggttacaattgcatattgaatattacaacaaggactgctaactctaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattcgttcaataaagattagagattcaaaatttggtttagctcttgtcatagaaagctctcagcagagtggtggatatgttcttggctttaaaatagatcctgtggaaaaactacaagaatcagttaaggaaatcaattcacttcacaaagtctattctgccagtcccatatttggagttgattatgagatggaagaaaagccccagccgctcgaagctctgacagtcgaacaaattcaagatgatgtagaaatagactctgatggtcacacggatgcttttgtggcttattttgctgatggcaataagcaacaagatcgtgaacctgtattttcagaagaactggggcttgcaatagagaaattgaaggatggattcaccctacagggactttgggaagtaatgagttgattgaccttgagttgagatggatttctattaaagatatctctagtttaaagatactagtcacctgccataagtcatggaatagtttttatatttacagcttttatatttaaaacttgtaagagtttttttaatgattgaggaaaaagtcatttagaaaacttcagttttcggccagcgcgtcgagggaggggccagcgacacatggcctagtaaccgtccggccgcggcgctggcttaagccatggctgagggtagctggattcctcaggcccgggcgctcctacagcagtgcctgcacgcccggctgcaaattcgcccagccaatggggacgttgcggcccagtgggtggaggtccaaagaggactggtgatctacgtgtgctttttcaagggagctgataaagaacttcttcccaaaatggccgaagctggactgtactgctgccatctctggctcactgcaacctccctgcctgattctcctgcctcagcctgccgagtgcctgcgattacaggcgcgcgccgccacacctgactggttttcgtatttttttggtggagacggggtttcgctgtgttggccgggctggtctccagctcctaaccgcgagtgatccgccagcctcggcctcccgaggtgccgggattgcagacggagtctggttcacttagtgctcaatggtgcccaggctggagtgcagtggcgtgatctccgctcgctacaacctccacctcccagctgcctgccttggcctcccgaagtgccaagagtgcagcctctgcccggccgccaccccgtctgggaagtgaggagcgtctctgcctggctgcccattgtctgggacgtgagcagcccctctgcctggctgcccagtctggaaagtgaggagcgtctctgcccggccgccatcccatctaggaagtgaggagcgcctcttcccacccgccatcccatctaggaagtgaggagcttctctgcctggccgcccatcgtctgagatgtggggagcacctctgcccggccgcgaccccatttgggaggtgaggagcaactctgcccagccgccccgtctgagaagtgaggagaccctccgcctggcaaccgccccgtctgataagtaaggagcccctctgcccagcagccgccccgtctgagaagtgaggagcccctctgcccagcagccaccctgtctgggaagtgaggagcgtctccgcccggcagccacccagtccgggagggaggtgggggggtcagtcccccgtccggccagccgccccgtccgggaggtgaggggcgcctctgcccagctgcccctactgggaagtgaggagcccctctgccccgccagccaccccgtccgggagggaggtgggggggtcagccccccgcccggccagccgccccgtccgggagggaggtgggggatcagccccccgcccggctagccgccccgtccgggaggcgaggggcgcctctgcccggctgcccctactgggaagtgaggagcccctctgcccggccagccgccccgtccaggagggaggtgggggggtcagccccccgcccggccagccgcccggtccgggagggaggtgggggggtcagccccccgcccggccagccgccccgtccgggaggttaggggcgcctctgcccggccgcccctactgggaagtgaggagcccctctgcccggccaccaccccgtctgggaggtgtacccaacagctcattgagagcgggcgatgatgacagtggcggctttgtggagtggaggtggggggaaggtggggaaaagattgagaaatcggatggttgccgtgtctgtgtagaaagaagtagacatgggagacttttcattttgttctgtactaagaaaaattcttaccctaaaacttaaagtataataaaaaaaaaaaaacttcagttttctaaaaattatatttaaaattgtaatcaaaatgtacctagtttataaatgtttattttgtacttaatacctgtaaagtcttagttttcagacattaagtgactgtatcatgttcggtttaataaagaatttatgcagcaccaaaaaaaaaaaaaaaaaaaaaaaaaaaaaaaaaaaaaaaa

SEQ ID NO: 27478 - DNA, 1781 bp, Homo sapiens
gccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctctaccaaaaaaaaaaaaaaaaaa

SEQ ID NO: 27479 - DNA, 6927 bp, Homo sapiens
ggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttagtcagcactgggtagcgttttgactccattcttggctttctttttctttccagaaggatttttgtgcagaaatgggtcttttgttgccatgttagtcctccttggaaggcagctcagaaggcctgtgaaatgtcaggggacaggacccccagggagggaaccccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttgtaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacacctgcgggggagcccaggcattctttgtaaaccctcctgaccacctggctcaaagaaaacagaagcatggagaccgccaagtattttcaagaaataaccccatgaatattccatcacttttttagaaagaggggcttggggcaggcagaggagagaagggagagcaaactgagagccaagtttccacacggtcctgcaggaggagaggatgcagctgcccagagggaagcaggatcacatttaaggaagtgtgtggggtccctggatgacaccagcacccagtgcggctctgtctggcacccgctcccaaggtgggaggagtgggtgtcccctgtgtgtcagtgggcagctcctgctgaacccgcagctcactagggagcctgacagtggggccatgcgcctgacactcctctctgcttgtggacctggcaaggcagggagcagaaaacagccacttgaaggctttctgtctgcgtctgtgtgcagtgtggatttagttgtgcttttttcttgctgggagagcacagccaccatttacaagcagtgtcaccgtcgtgggtggcgaggacagaacaggagcctctgctctctgtacctatctgggcccggtgggctcccttgtcctggcttccatctctgtctcagcgaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccacctcctgcctcaacagcctgtgtggtggcaaagccggtgtggggctggggaacgcagcgttctccaggagggggacctggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacga

SEQ ID NO: 27480 - DNA, 567 bp, Homo sapiens
cagcgggcacgtgacatggccccggggagccgaggtgagcgtccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctccccaaaccctatccctcctacctcacccgcagggggaaggagggaggctgacaagccttgaataaaacacaagcctcc

SEQ ID NO: 27481 - DNA, 2867 bp, Homo sapiens
aatcagggagcgccgcgcgagggtggggaccagctgcgcacgaggccagcggcggggtcgctgccgttgaggcttcccgccactgctgctggcggatttgtggggcaaaatttctcgctggctagccttcttttccctcccgcactttggtggggagggggtggatcctcgtttcggtgcccaagttcacgatgacccgagagaactcgaggaagttgtcgccgcggccatttcccccagtgccgcaacttgctggccttggagggggaggagcgccgaggcagtgactgcgacgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggtttttaatctctaaaatttctacagtagtacaggaaatattcctctttacattcatttgcagttctttcactgacctcctaattttaggtggagggggcagggggagccataaaagttggtattaccctaataaatctatctctttcctcccctgtttcaaccccacatgtattccatgctcagcagcagcagcagaaatagtaggatatagatcacaaaggtttttctggtgagtcaaatagggtgttttcttttgaaactgtaatgaatatgtttgccagtcaaatggcttcatgagaacagtagaaccttatgaatgtatactagcatacaaggatctcaaatacattaattattctcagttttaggaatgtaaatagattaagtcccacaatgaaatttcagaagtttttgttctgtaagtaaaaaattactaaccactgatgttcaagattttcttttaatagcactatccttgagaaccaaaaagtttatgttttgattttcaaatgttaaacaagatgctaaacaaatcctggactgttaataaaaattaattatgtattattggataaaaaaaaaaaaaaaaaaaaaaaaaaaaaaaaaaaaaaa

SEQ ID NO: 27482 - DNA, 2804 bp, Homo sapiens
gaggcgacgcagtccgcttctccccacccgccaggtggcaggttcagggccggggtccgagcctgcttccctgcagctgccacagccaccctcgccgccagggggcgagagtcccaggcaggacaagcagcgctgctgccttggcgtgaaggtggtttcaaactttaggcttcttttccctaccccgcgtctctgaagagcagagaggaagatggaaaccgagtccgggccgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggtttttaatctctaaaatttctacagtagtacaggaaatattcctctttacattcatttgcagttctttcactgacctcctaattttaggtggagggggcagggggagccataaaagttggtattaccctaataaatctatctctttcctcccctgtttcaaccccacatgtattccatgctcagcagcagcagcagaaatagtaggatatagatcacaaaggtttttctggtgagtcaaatagggtgttttcttttgaaactgtaatgaatatgtttgccagtcaaatggcttcatgagaacagtagaaccttatgaatgtatactagcatacaaggatctcaaatacattaattattctcagttttaggaatgtaaatagattaagtcccacaatgaaatttcagaagtttttgttctgtaagtaaaaaattactaaccactgatgttcaagattttcttttaatagcactatccttgagaaccaaaaagtttatgttttgattttcaaatgttaaacaagatgctaaacaaatcctggactgttaataaaaattaattatgtattattggataaaaaaaaaaaaaaaaaaaaaaaaaaaaaaaaaaaaaaa

SEQ ID NO: 27483 - DNA, 3119 bp, Homo sapiens
cagtgcagatgttcctgggaggtcaagttaagagtcaaaaataattcattagatttaacaatttagcatggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcatactgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaaaaaaaaaaaaaaaa

SEQ ID NO: 27484 - DNA, 3157 bp, Homo sapiens
gggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcatactgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaaaaaaaaaaaaaaaa

SEQ ID NO: 27485 - DNA, 5437 bp, Homo sapiens
caggcagccccagcgtccccgggccctcggccccaccgagtgccggctcccgcgctctgcggcggcaagccccttggaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtagagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttattccatatatacacacacacacacacacacacacacacacatacatacatacatatatatatatatatacatatatatacatacacacatacatataattttttttttttttgagatggagtttcactctgtcgcccaggctggagtgtagtggcacattctcagctcactgcaaactccacctcctggattcacgccactctcctgcctcagcctcccgagtagctgggactacaggcacctgccaccgcgcccagctaatttttttgtatttttagtagagatggggtttcactgtgttagccaggatggtctcgatctcctgacctcgtgatccgcccaccttggcctcccagagtgctgggattacaggcgtgagccaccgcgcccggcctattccatatttttttaatgggacattttagagaaaggtgtgatttgactggttttatttttctcccaggccagaagtattactccactagatcaccttacttaattgggcactgtgtggataacttgataatgaacaaaactctcagattttactcacattacccttgtattatgccatttataaactgctctgaaacctgaagctggaaagataacagatgggtttctgagcacggggttaacctccagctaaactcaacttccttgggatttggagtcaccatgttgtgcacactctggtgtgggaaacactttatgtagggtgggaggacaggggagttaaatggctgggcaggtgccacaggatgaggccactgaaagatctgcttcattctttgatctgtattctgaagttccagattgttcatctagaggcagagacatctcttttaaaaaagtgccagatgccccagtgccagagctgcgaacgtgaacacagtggaaggcagagggtttactacaggccaggccatggacaccccacccaggtactgcagtgagggccttgattccagagctctttttcctactgaaatcatggtttagtaaacagtggcatttggctggtgggaaatgcgtaactggtcagtgtgtctggccagcgtggctgtggcacttggccaggacgctccgttgaatgaagctcattgattggccatgctggtcatgtctattttgcttcatccactagaaccaactttgagtcagtctcctgttacgttaaatggctaagaaaagttccaaatgaagttgttctcaggtgaactgagccaaaagaagcaactcttaccatgaggtgatttctgttagaggagacatataaataagctcatctagggtcacctcattttcctaaatatgtttttaaagcaattattgtagtaatttcatttgagttaaatttacatgctcggtcactcattgagaaaatttacacagactctgaatccagttcctgtcatcttcagatgttggtttattgacatcacagtaaaaaggctactgtcgactggacacagtggctcacacatgtaatcacagcactttggggggccaaggtgggtggattgcttaagcccaggagttcaagaccagcctgggcaacatggctaaaccccatctctacaaaaaaaattagctgggtgtggtggtacatacctgtagtcccagctactcagaaggctgaggtgggaggttcacttgaacctgggaggttgaggttgcagtgagcacagatcacaccactgcactccagcctgggcaacagagtgagaccctatttcaaaaaaaggctgctttcactgtactgctgcagcagtctcttcaggtagctaaattaggagcttgttttggagaaatgaagcaaaggtgaatgacagcctaggcttgaaattataaagctctctcaggttgaactctctcgtgcgctctcgctctcactttcgccctgtacctgagagcacaggtgtaactgtgatgtcatagtgccgagactactttcctttaaccattggggttaagttgggcagcccatttagtttacacgcgcataagactaatttacaaaatcactctatacagtcattagatgtaacatccttccctgagtagaaagtaatgcatgtgtttggagattattttctgtaatgctgggaacaaacctgttttaaaagcacactgctaaaagtaggtgatataagaccatttgctgtttttattaaagtatgtgtgtgtatcagtgtctcaatgtgaagattgtaacctcaagattaggaatcttaaaagagccacttagcctgaatgggaaacgtgagactatttttaaacacacacctctaaggaagaagcctcccatatagacttgatctcaaagaagcagataagaagacagaaaagtgttttaagtgtaagatctcctatggagtactttaaattcatttatacaaatgaataagtgtatctttgtataatgcataaatacatagataaaaacatgtttgctgccaaagttcccaataagatgcttcctgtgttttttggcctttacttagctgaatgatcaaagttcagaaaatggtctgcaaaagttactccatatacaaccccaaatctactactttaaatgtaacatcaactcagttgtatgaatctggagtgtaatatttatattagaatgtatatgtcatttaaaatattttgaaagccctcataaatatttatatttactaaactaatagcatagacactatataaatccgcagtgatgcttatatatcttaaattagtaataatgggtgctatataattattttcagttactatccctgacactctggaatcttctccatttctccctatcactcaatttcattttaatcattggacacctttgcgttttgctgctaacagtgtgtgtatgtcaccctctttatatctggttttcccacttgtctgaagctctcctgatcttagaacctggagctgcagattcctccatgtcagctcccatcacggccccaaagacagagtcacttggttgctgagtcacttggttgctggaaaaatctttggggaaagctggtataagctacacactgacctgtccccagtgtttccaggtaatgacttggcactccagagaaagtttcatgctgttgcgtgtggtggctccaagccaagcacctggcatgcaggtcagcccttcccagcgggcgtggcgtcgtcctcttcacagatgccacgttgcagccccaaggcctcaccattttgcgttttttagaaacccattttcttggtcatttataaagctgctttatagatatctttgatcctggcatgccttggtttcctctcccttccctctttccaatcctggtttcctaacctcctcttgtagtaattctcaactcaactcaaagtcccaagaatttggaatggtaggatgctgtgcggggagctcgaggctgaggcataatcactgcttcggttctgctcatcaggggacacgctcccttactcatggcagccatgtttgattgtcacagagccccccgaatactctgtctatagtgacacactgtaggtgtcataaattttaagaaacctgcttttaagtactatttataggtttttctgttatacttgcaacctagttttaaaatacatgaggattttatgaaagctttatacagacatttataggaaactcattctttgattttaggtgccatttaaattgataacacttactttataaaaagatgctttttgtctggatagagccttatagtttaaaatatcttcatatattgccatttgatcaaataaatttcttacttagaaaa

SEQ ID NO: 27486 - DNA, 5507 bp, Homo sapiens
agagcgccgatggctggggacccgaggtccgcgccacccacccgcaacctccttccccgagcctttgggaacgggttgttggccagacaagtcccagaaactgcctgctttgaagcatgaataagtgcgaaaagactcttagcaatgaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtagagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttattccatatatacacacacacacacacacacacacacacacatacatacatacatatatatatatatatacatatatatacatacacacatacatataattttttttttttttgagatggagtttcactctgtcgcccaggctggagtgtagtggcacattctcagctcactgcaaactccacctcctggattcacgccactctcctgcctcagcctcccgagtagctgggactacaggcacctgccaccgcgcccagctaatttttttgtatttttagtagagatggggtttcactgtgttagccaggatggtctcgatctcctgacctcgtgatccgcccaccttggcctcccagagtgctgggattacaggcgtgagccaccgcgcccggcctattccatatttttttaatgggacattttagagaaaggtgtgatttgactggttttatttttctcccaggccagaagtattactccactagatcaccttacttaattgggcactgtgtggataacttgataatgaacaaaactctcagattttactcacattacccttgtattatgccatttataaactgctctgaaacctgaagctggaaagataacagatgggtttctgagcacggggttaacctccagctaaactcaacttccttgggatttggagtcaccatgttgtgcacactctggtgtgggaaacactttatgtagggtgggaggacaggggagttaaatggctgggcaggtgccacaggatgaggccactgaaagatctgcttcattctttgatctgtattctgaagttccagattgttcatctagaggcagagacatctcttttaaaaaagtgccagatgccccagtgccagagctgcgaacgtgaacacagtggaaggcagagggtttactacaggccaggccatggacaccccacccaggtactgcagtgagggccttgattccagagctctttttcctactgaaatcatggtttagtaaacagtggcatttggctggtgggaaatgcgtaactggtcagtgtgtctggccagcgtggctgtggcacttggccaggacgctccgttgaatgaagctcattgattggccatgctggtcatgtctattttgcttcatccactagaaccaactttgagtcagtctcctgttacgttaaatggctaagaaaagttccaaatgaagttgttctcaggtgaactgagccaaaagaagcaactcttaccatgaggtgatttctgttagaggagacatataaataagctcatctagggtcacctcattttcctaaatatgtttttaaagcaattattgtagtaatttcatttgagttaaatttacatgctcggtcactcattgagaaaatttacacagactctgaatccagttcctgtcatcttcagatgttggtttattgacatcacagtaaaaaggctactgtcgactggacacagtggctcacacatgtaatcacagcactttggggggccaaggtgggtggattgcttaagcccaggagttcaagaccagcctgggcaacatggctaaaccccatctctacaaaaaaaattagctgggtgtggtggtacatacctgtagtcccagctactcagaaggctgaggtgggaggttcacttgaacctgggaggttgaggttgcagtgagcacagatcacaccactgcactccagcctgggcaacagagtgagaccctatttcaaaaaaaggctgctttcactgtactgctgcagcagtctcttcaggtagctaaattaggagcttgttttggagaaatgaagcaaaggtgaatgacagcctaggcttgaaattataaagctctctcaggttgaactctctcgtgcgctctcgctctcactttcgccctgtacctgagagcacaggtgtaactgtgatgtcatagtgccgagactactttcctttaaccattggggttaagttgggcagcccatttagtttacacgcgcataagactaatttacaaaatcactctatacagtcattagatgtaacatccttccctgagtagaaagtaatgcatgtgtttggagattattttctgtaatgctgggaacaaacctgttttaaaagcacactgctaaaagtaggtgatataagaccatttgctgtttttattaaagtatgtgtgtgtatcagtgtctcaatgtgaagattgtaacctcaagattaggaatcttaaaagagccacttagcctgaatgggaaacgtgagactatttttaaacacacacctctaaggaagaagcctcccatatagacttgatctcaaagaagcagataagaagacagaaaagtgttttaagtgtaagatctcctatggagtactttaaattcatttatacaaatgaataagtgtatctttgtataatgcataaatacatagataaaaacatgtttgctgccaaagttcccaataagatgcttcctgtgttttttggcctttacttagctgaatgatcaaagttcagaaaatggtctgcaaaagttactccatatacaaccccaaatctactactttaaatgtaacatcaactcagttgtatgaatctggagtgtaatatttatattagaatgtatatgtcatttaaaatattttgaaagccctcataaatatttatatttactaaactaatagcatagacactatataaatccgcagtgatgcttatatatcttaaattagtaataatgggtgctatataattattttcagttactatccctgacactctggaatcttctccatttctccctatcactcaatttcattttaatcattggacacctttgcgttttgctgctaacagtgtgtgtatgtcaccctctttatatctggttttcccacttgtctgaagctctcctgatcttagaacctggagctgcagattcctccatgtcagctcccatcacggccccaaagacagagtcacttggttgctgagtcacttggttgctggaaaaatctttggggaaagctggtataagctacacactgacctgtccccagtgtttccaggtaatgacttggcactccagagaaagtttcatgctgttgcgtgtggtggctccaagccaagcacctggcatgcaggtcagcccttcccagcgggcgtggcgtcgtcctcttcacagatgccacgttgcagccccaaggcctcaccattttgcgttttttagaaacccattttcttggtcatttataaagctgctttatagatatctttgatcctggcatgccttggtttcctctcccttccctctttccaatcctggtttcctaacctcctcttgtagtaattctcaactcaactcaaagtcccaagaatttggaatggtaggatgctgtgcggggagctcgaggctgaggcataatcactgcttcggttctgctcatcaggggacacgctcccttactcatggcagccatgtttgattgtcacagagccccccgaatactctgtctatagtgacacactgtaggtgtcataaattttaagaaacctgcttttaagtactatttataggtttttctgttatacttgcaacctagttttaaaatacatgaggattttatgaaagctttatacagacatttataggaaactcattctttgattttaggtgccatttaaattgataacacttactttataaaaagatgctttttgtctggatagagccttatagtttaaaatatcttcatatattgccatttgatcaaataaatttcttacttagaaaa

SEQ ID NO: 27487 - DNA, 1064 bp, Homo sapiens
gaacacctcccgtcctagcttattgccggagtatgatcagagaatggaagaatgactgtcagaggattgaaaaacagagggctagtgacacaatggtgcaagaaaggaagaatgaaaagccagttagaatatttaataccaactcttcctttcaggatcaagccccaacgtgttgccaagaggatctgagttctgcttcaccgttgcggatatggagcaaattctacagatcagacccacggattgcccttgggaaatactcccccttggaaaaagagatcctacgtctaggtggcattcacaccatagcagcaagaaggcttttggcttacaagcaagaggaagaatgcagaatgctcaaggaactacagttgctgtctccggactacaaacaagcaatggagtataaaaagaaacattcctctccttgtgctatttgtgtacccctagaaaaaatatggacagcaaaggtgattgcgcccctggaggcatttaaaatgccacaacgagagcaggtgaacgtcagtaagcacatagagaggatgaggcttgctcgggctctgggaaatcatcagcctttaccctacattgaaaggtttacacgctcctcatttctgtctggggtgggcctgggtccaatggcaaaaaataaggccagacgaaaggaagacaactatgacacccataattgtgatgatgccaaccaagataagaaagaggaggcagagggaaaaaacacaaaaagacgagaaataaaaatgaatgtagttttcaagtcaaaagaaccaaaaaaatgtttaacataccatggaaatgatcgcaaatcattcctccccgcaaagaaaccggaacggtccatcgcaggcctaacaaaccgaaatcttttctgcatatcagaattccctggtgacttaatgctaatgaatcaggattttatatcacggagagaccacttcagtgatctggtcaagacctacagcctggaagaagagagtatctggaaagagcgcatgcgtaaagcaactccttatcattattaaagttttatttgttgcccagggtaa

SEQ ID NO: 27488 - DNA, 722 bp, Homo sapiens
gcttcccagacgtgtagagcttatgaagtttaggaagcagcttcccagacatgtagagcttatggagaggtgagggagccaatctcagccacattcagcttcctggagagaatgaccaaagggcgacgcttcaacccaccttcagacaaggatgggagatggttccctcacatcgggctaacgcaaaagacaccagaatccatcaccagtgctacgtcaaaagagccccagagtccacacttgcctcggcaagcggaggggaagctgccgcccatatacaaagtccgggagaagcaagcagtgaataaccagttccccttctccgtgcatgacaatcggcacagcttggagaactctggatgctaccttgactccgaaagaatgacagcaacggacccacagggagaaccagacaagagacaagagttctatgagccggtgaggacccagtccattcctcatccaggcctgagaactaatgcacccctccttgcagtgtgagctctttgggagcaagtttctgtcacccattccccagagtcctgactaatagaatgtgtattagttgggaagaaaaggaccttttgtcttagcctagctagttagtaaccaccaggatttattcagcattcttggaaaaataaatttccagctatggagaaatcctcttattctgcttgcctgtgtgggcgcaggtattaatagggctatctccctggcag

SEQ ID NO: 27489 - DNA, 910 bp, Homo sapiens
ggctgagaagtaaagatcaggaacaaggaggaggaggagcttcccagacgtgtagagcttatgaagtttaggaagcagcttcccagacatgtagagcttatggagaggtgagggagccaatctcagccacattcagcttcctggagagaatgaccaaagggcgacgcttcaacccaccttcagacaaggatgggagatggttccctcacatcgggctaacgcaaaagacaccagaatccatcaccagtgctacgtcaaaagagccccagagtccacacttgcctcggcaagcggaggggaagctgccgcccatatacaaagtccgggagaagcaagcagtgaataaccagttccccttctccgtgcatgacaatcggcacagcttggagaactctggatgctaccttgactccggcctgggacgtaagaagatctctccagataagaggcaacatgtttcaagaaattttaatctctgggcatgtgactatgttccatcttgtcttgatggcttttcaaataaccaaatatcatacgtatataaagaagccatggtggtctcaagcttcagacgctttccacgatgctataaagagatatggaacgcttttacatttcttcctgagagaagctatacagaggttttgaaaaagaagcccaaagtaaggttcactgttgacaaaaaggttgtttcttcactggagtcctaatcctcccagaagatttttgatgaattttgtaatactggtatttcatcagacatcctaaaagtatatgttttctgatccagcaccactatttaatttttaaagtacttttatgatttttataaggtcaaaaaacattcaaatccttgtgaaatgaatttgtgatgacatacgcatgtgtaaataaacttttcagatggcca

SEQ ID NO: 27490 - DNA, 910 bp, Homo sapiens; identical to SEQ ID NO: 27489

SEQ ID NO: 27491 - DNA, 867 bp, Homo sapiens
ggggagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatgcaaaaaaaaaaaaaaaaaaaaaaaaaaa

SEQ ID NO: 27492 - DNA, 1250 bp, Homo sapiens
ccttggggagcctgccctttcaagcatgaatcataccaccagagatcacccagcttgctcttagctctgcctgcctggtgtagggtcctggagaccttcttggagctcatccagcagccatcatgcaaggtggtgctggggactgccctcttgctaggaggtggaggtctcatgctgtgggttcagagaaagaggagaagaaaggaaacctctgagtgtccatcagacaaggacaagtcaccagaatcccataaagcaaagaatgaaagctggattaaatcccactttagccgcctttccgaagagaagctggccctcgacaacaatgccagcgctagtggcaatgctacccagactgagagtgggagtgaagaggtcagctccacggttcacatagagaccttcaccacgaggcacggagaagtgggctccgctctgcaccgggaatccttcaccagcaggcagaagacatctgggccctcagtgatccaagagatccaccaggagtctggaaaagccccatccactgatgacgccacgtgggccgctgtggctgcctgcaccaaggagattgacacccaggggcggcacctggctcactccatgctgcagcgggccatagcttaccagcactcaggtcacctggagtccaaggacatcaaccaggaggagctgagggccctcgaggaggtagagatgaagctgcaaaagaatttcctcacccagcgggaaaacaccatagctggtgccaatcacacacacaccttctatggccacagtcaccacagtcaccatggccacccaagccaccagagccacagcctgcctaatcgcagacactagatctgtgacttcttggaagccacctaaccatggatggagacgcccctgcccccagcaaggctggctcacacacacgtctgttttctctcctatggggccatctatgcaggccagggtgagatgctgtgcccaaatccctactttcttaggctcctcacggggattatgggctctttaaactccatgagtggggtctgccacagaagatggcccctgttggagggagagctgggaggacacagcgcaggtgagatagaccctgaggcccctgaagacccaccaagagaagacagatgggagcaggcaagagccccacactgatgtcattgcctggaacggagccaataaagctttgtgtgccttcaaaaaaaaaaaaaaaaaaaaaaaaaaaaaaaaaaaaaaaaaaa

SEQ ID NO: 27493 - DNA, 2717 bp, Homo sapiens
acttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagctcagagaagaaacgatctagccctgctatttcagatctttcacagatccttaagtctcaagatgaatcagcatttttagagagttcaaatgaagtttcagttgctgaaaaccaatcctataaatctccatcagagacccatgataaatcacttacaacagtatcatccagcaaagaagttcaagattcactgtctgttggaacattggctcaaaaaaacgaaacagtgatatcaccattcattttacctcctgttcttacagaaagtaaaaaggctgatgtttcagaagaacaattacaaaagatgactgaagaacaaacttaccaagcagcagaaaaatctcaagctcataatgaagtaccaaatgaaaggcttgtagttgagcatcaagaatcattgtcaaaaaccaaattacaagtaaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaaccaggcaaaaatcttgtgcctgaacatcaagattcagtgtcaaaactggaaatgcaaattgaaaaaaccaaaaaacttcctagagagaaaagacatagtactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaagtgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaaccaagaaacttcaagctaaagtaacttcaagaaaaaagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatgcagagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacaattggaaaacctacctataaagtgttacatgctgctgcccgaaaatctgtaccacacccatacttttgagaatgaaggaaattctgagcaagataagcaacatgacaaattcagaaatgcaggaaaggaaatcgcaagtatagaagccttttgaaaataatactgactcgtgtggatggtgcttattgaaaaacagctggaaatacagtggatcaacagggtaggcccagatcacagaaggcctgaccaggcagtgaatgtgtctttaccatatggaacaattttgaacttctaagatcaagcctttttgttgctgagggtaagaaaggagctctgtgatgaggttccagcttacttctattcgccagtgtccctgtaatgctttctggtgtgatgtaaaatcaattaaacaaaacttgtgctctg

SEQ ID NO: 27494 - DNA, 3313 bp, Homo sapiens
gcgccgagcgcgggtttccgctcggggcgggcgatagagacagcgcgtcgcgcctttagcttctttcccagactccggcccagctcctgcgatctccacagcagcctctgaggccgcccccagagagcatcaggatggctgaggaaaagggtggaaagcaagtcctggaagaatctgcatttgaagaaatggaaagagattttcagggagttctccatgaactttctggagacaaaagtttggaaaaatttcggattgaatatgagaggcttcatgctgtcatgaaaaagtcttatgacaatgaaaagcgtctgatggccaaatgcagagagctaaatgcagagattgtagtgaattctgcgaaggtcgccactgcccttaagctctctcaggatgatcagaccaccattgcatccctaaagaaggaaattgaaaaggcctggaagatggtggactcagcctatgacaaagagcagaaggccaaggagacgattcttgctctgaaagaggaaatagtgaacctgaccaaactagtggagcaggggtctggactgtcaatggaccagcatagcaacatccgagatttactgaggttcaaagaagaagtgacaaaggagagagaccagctcttatcagaagtggtaaaattacgagaatccctagctcagaccactgaacagcagcaggaaacagagcgatcaaaagaggaggctgaacatgccatcagtcagttccaacaagaaatccagcaacgtcagaacgaagcttcccgggagttccggaagaaggaaaaactagagaaagagctcaagcagattcaggcagacatggacagcaggcagacagaaataaaagccctgcagcagtatgtgcagaagagcaaggaggagcttcagaagctggagcagcagctgaaggagcagaagatattgaatgagagagctgcaaaggaactcgagcaatttcagatgagaaatgctaaacttcagcaagagaatgaacagcacagtttggtctgtgagcagctatcccaggaaaaccaacagaaggcgttggagctcaaagccaaagaggaagaagtccatcaaatgcgccttgacatcgggaagctcaacaaaatcagagaacaaattcataagaaattgcaccacaccgaagatcaaaaggcagaagtcgaacagcacaaagaaaccctaaaaaatcagattgtgggattagagagagaggtagaggcttcaaagaaacaagcagaacttgacagaaaggcaatggacgagcttctaagagaaagggacatactaaataagaacatgcttaaggcggtcaatgcgacccagaagcagacagacttggtaaagctccatgaacaagccaagaggaacctggagggagaaatccagaactacaaggatgaggctcagaagcagagaaagatcatctttcatctggaaaaggagcgtgaccggtacatcaaccaagccagtgaccttacgcaaaaggtccttatgaacatggaagacataaaagttcgtgaaacacagatttttgactacaggaaaaaaatagctgaatcagagattaaattaaaacagcaacagaacctatatgaagctgtgagatcagacagaaatctgtatagcaaaaatctggttgaggctcaggatgaaataacagatatgaagagaaagttaaagattatgatccatcaggtagatgagctgaaagaagacatctctgccaaagagtccgcacttgtgaagctgcacctggaacagcagcgaatagaaaaggaaaaggaaacattgaaggctgagctgcagaagctgagacaacaagccctggagacaaaacactttattgaaaagcaagaagctgaagagagaaaactcctgcgaataattgctgaggctgacggggagaggttgagacagaagaaggaattagaccaggtcatcagtgagagagatatcctggggtctcagcttgttcggcgcaatgatgagttagctttgctctatgagaagatcaagatccaacagtctgtgctgaataaaggggagagccagtacaaccagaggttggaggacatgagaatcctcagacttgagatcaagaagcttcgccgggaaaaggggattcttgccaggagtatggctaatgttgaagaactcagacaggagttttttcacatgcaaagagaattgttgaaggagaggacacgctgccgagccctggaggaggagctggagaatcccctgaatgtgcacagatggaggaagctcgaggccagcgaccccaatgcatatgagctgatacagaaaattcacaccctgcagaagcgtctcatcagcaagactgaagaggtggttgaaaaagagctgctcctccaggaaaaggagaaactctacatggaactaaagcacgtcttggcccgccagcctggacctgaggctgcggaacagctgaagctgtaccgacgcacgctgcatgacaagaagcagcagctgaaagttttgtcttcagaattgaatatgtatgaagtacagagcaaagaatataaatatgaggtagagaaacttaccaatgagctccagaatttaaagaagaaatacctcgctcagaaacgtaaagaacaacttcaaaaaaacaaggacacagcacccatggataacaccttcttaatggtcaaaccaaatggtcctggttttactgggggcggatttcctctcaggtcaaccaaaatgacgttctaacctgaagctgctggctgtttccagttgaacaactcatgaaatctgctctgggacattttgggggaatctcaaagtccttggatcatagaactgagtgctgagaatccaggatggaaagaaatgcagaactatcatagtcacatacatataagagggatggtgttttgtctggttcacgttgatattaacagatcataattctctctgttcagttaggctgacctattgcatgaagcaaatcttttgttgctaccccattgattgaaatgtactagaccttaatttctttattacagacattggtgtacttgaaggttttatatttaaaagtatttttgaaatgcaatgtgtcccctctcaccttattaacaataatctattttaattattcctcattaacaagtcattgcatgagatgagaaagaaggacaaactcttaagaatttaaaaagtgttttgagaatgatttctatatggaatttcttttcaggcccggaatgggaaaatctattccaaagagacacactaataaatacttcattataaaaaataaaaaagaa

SEQ ID NO: 27495 - DNA, 2746 bp, Homo sapiens
gtcctaagatggctgctgggcgaccacttcctgacagctccagttaacgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgttcatttgtatggatggacccttggtataaaatcacttttggcgctttccattcatttggtttagcacagccagtgagcttctcgtactttctttcttttttttttttttttgagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgttttttttttaattggaggcagacttgatatttcagagttgcatagtaaaagcaatttgttaatttttgtgtattttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 27496 - DNA, 2119 bp, Homo sapiens
cggaggggggcgccgagccgcagtccccgcccccacctcccgcctaccgcgaaaaacgcggaaatgcggtggctgcggcccgcgggcaggcgtcgggagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaagagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccgggagctacagcagggactcagaagatctccagaaaacccactcacccaggcacggcgagccggtcctgtcgccccagccctgcacagaccccgaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgtaaaaaaaaaaaaaaaaaaaaaaaaaaaaa

SEQ ID NO: 27497 - DNA, 1817 bp, Homo sapiens
gttggcgggcagcggcacggccggcagggtcggggtccacaccagggcgcagaggacggccgaggcgtgtctgggccggcagccctggtagcaggcggggaagaggtcggagaggcagcgctccacgctgaaggccgccagcagccagagccccaccgcgaaccacaggaagccatccctcctcccccaggatccacatgggtcgtgttcttagtcctgggagatgcatcaggaccaggctcagcagtggcggcgtcagcgaacactggacagtaagatgttcttgataagagactttttccttccacggactgcgttccgcagctcctgggtggggtgcagagtgtgtcagctcaagccagaaattcggtcgtaaagatgctgtttctcttcatgtttctcaaatggacttggcttcggaaatcacttctgcaacacaaaccagcagcctgtgcagctctgggcgggggcatgccggctacccagctcccggcattgttgcacatggctttgaaacgcacggcacagctcgtgtggcccaggggcacctcctgccaccctgcctgctgcctccaccccagatgccggtcctcgctgctctccgggacctctcccggcgtggctccacctcctcctcgaggtcaccgtccaggcctgtttcaactagcgcctccaagccttgcttacctgcctcctgtttgggtgaaacttggagcatctctattaacttagttggtagctccggtcacctgcagtcaccaggggcccagagggacgcacagagggagaccggctgcctgggtcccttctggctgcctcaccatcaggtgcgggatgaggagctcagcctcagccacagtgcgcaaggtgaagagttttgatccctcgcacatcctcgagccaggcagggcgcccggcttctatcccaggtagcagagtctcctatcccaggtctccgacggcgaccgcaaccctttgcccgtggaggacttcccctgtctaagggccattgggagtgggatggcctaatttctggggtcgctttctattgggcacttcaaacagtgctgggcaagggcagtcgtttgaggcagcttggggtgaagttcttagggaggaggtcctgtgcagctccgccagccccggtcaggcccaggcagccaccaaccctggtttctccatcacccctgacccctcccacagccccttctcgtgtttgcccaccgtctaggccatgcttccactttctcacctggctgggtatcccctatggggcacgggtgtcggccccgcagaggctgggctttggtctgtcttgttctctctgggaggggtctggtgcgggtggaatacgtggagggagcctccgtagggggagcaactgctcccggtgttgcaaggaggacagagccaatgcccgccccatcgtgtcatggccgacggtggcctcagaagatgtgtccacgtcccagtcgctggaagctgtgcacgagctcttcctggagaaaaggcccttggcagatacaaggattttgagatgagctcgtcctggagtatctgtgtgggccctaaatgcaatgacaagtgtctctatacaggaaaggagaggagggacactggagagcagggggaggccacgtgaggttggaggccagcaggggttacacagccacaggccaaggagggccagagccaccagaagctgaaagagatgaggaagcaccttcccctggagccctcagggagcgcggccctgctgccaccttgatctcagacttctgtcctctgtaaccaagggaataaagtcctgctgtgtg

SEQ ID NO: 27498 - DNA, 1168 bp, Homo sapiens
ggttcctgcagcagccactgccctgcccaatccctcccataccccaccatgttggtgggtacccccaacctgctgacactggatgaagctgatgccacctggaccctcatcaaggataaggtcatcgaggagcactttgggcccaatgcagtagcagtacctttcctgtcagatgcagcctgctatgacctactgggtgtgctggtaaaacagtcccgcccagcccatacccgcctggctttgccaggtcggcagggccggagggcactgaaaccagtggggccactaccaagcctcctggagcaggcaggatctgagggtgccttcgcccactgcactcgggaatactcaccaaatggccgagcagagagagcctatgaagagacgcgaatgttggatggacagccctgcaagatccgcctacatatgggtgacctgcgcaagaaggttgccttcctgttgctgccaccagggcaggtgagcctacagcagactcttccctggctccgaagcacccacagcatctatgtcatctaccaggtcttctcttgttcctggctgcagctggggctgacgtctacagcccgtgagccccagctcctccggctacttcggtcattacctgttgccttctcctgcctcaagttttcactgcagtctaagggcgtgctgggaccacagaagcctctcactaaagacccattgccccatggggccaactgggtcagacccaacctcagcatcatgccgcctctggcccccacatcagcatctgctgatacaactgaagctgctgatgtgcccccacctgtcccagccccacctacgccacctccccaggaagggccagaggacaaacccaccagattctcctacaagggccgaaaccccttctggagggggccccagatactgtcagagaactggctcttcagcccccgcagccctccaccaggagcccagggtgggggccccagggaccccgacgggcactccatgtccctgcccctgctgcagggtctatcctcagagttcgacagtgacgactgaagctgaagcaaaagattccgggggcaaagcccccaagatctggcataggggtactggtctctaataaacatcagctgctgctcccccaaaaaaaaaaaaaaaaaaaaaaaaaaaaaaa

SEQ ID NO: 27499 - DNA, 1705 bp, Homo sapiens
aagtttgagtttgtgtgcttactagcaaccactttcagcgtttctgcaaagctagagaagggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatgatgcttctagtttatggacaaagacccctgaagaaattgaagaaaaaagagcaataaaggagatgtgttataaatctggggaatactacagatttcatactcctccagatattttgtcatcaaaaagcatgacacctacagcagaaaaacagttagaaaagcctttggaaaatggcagtgaattgcaagaaggagatagtcttacagttccgacaaaacttagccaatatgaaaggcaaggtgaaataaaaacatcattgcatgggaaaccaaagactgacattgctgcttttgaaaatggaggaggtgactgttatgttccacagagggtcatatttcttggagtcgatgaaagtgaagctttaactgaagagaaagaaatcaccatatcaaaatgttcaaatactaaagataacaaggacagtcctcatccaaagcattccctaactacccgactagtacctacaacgcatgtattaaatgctactgagaatatcagtatgaagtgcagagaggacccctcttcaatgaatgatgtccagccagtgaagaagcctcattttaaaggtgtgaagaaaagaaaatggatttatgatgaaccacagaactttcctaactctggaatgcagagagcagtacaggccccaagaccccaaaataaaatgagttatcaccgcaataataaaaatcgaaatgcggagaatgcatcctatatccacgttcaaagagatgctgtcaggactgtcgcgttgaatgcaccttcccgcagcaggcccacgcatgggtcctacaataaagtccatgctaacagggaacccaaacccaacctcagtccagacaaatatacgtcaacatcatataatgattcagcctggcgaaaacgaattcctttttcaaaaacatattcaaaaagtgaaaagatatatccagagccaagaagaaatgggagcaagtaaacctggaggttgagagagagaaaaatgagaaaaaattgccagacatcatctgatttacaatcaaaaatgaaaattcaaagaatgagatactcaagtactccatgttatgtagtggatagccaaagatgataaaaatgcaaattctgaaaataagatgcaggaagtacattgtgctctttcaaaactgataaaaatgcaaattaccaacagctgccagtgtatttatgtaggtctggaattcattccgtgcattactccaaacattttaataaaatttaaaagtttgacaatt

SEQ ID NO: 27500 - DNA, 4055 bp, Homo sapiens
cagtgttcacagatgtgaagcaagataatggagatctgttggaaaacaagcatggtgaattctggttagagttcaatagtggttcattattttgtgtgacaaaatatgaaggttttgatgacaagcactacatttgccttcattctagcagtttcagtctgtaccataaaggcatagtggatggagtgattctcccgacagaaacacgacttcccagctcaacccgcccacactggttggaacctactatttattcctctgaagaagatggcctcagtaaaacttcttcagatggagttggaggagacagtttgaatatgctgtctgttgccgttaaaatattgtctgataaatcagagtccaatacaaaggaatttctcattgccgtaggactgaaaggagccactctccagcatagaatgcttccttctgggcttagctggcatgagcagattttatacttcttgaatattgctgatgaacctgttttgggatataatcctccaacttcatttacaacttttcatgttcatctttggagctgtgcacttgattatagacccctttatttgccaatccgatctcttcttaccgtggaaacattcagtgtttccagtagcgttgcattggataaatcttcctctactctcagaataatcttggatgaagctgctttacatctatctgacaaatgcaatactgtcactataaatctgagtagagattatgttcgtgtgatggatatggggcttttggagttaaccataactgcagtgaagtctgattctgatggagagcaaactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttgaaagaaggtctaaggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaacagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgcattgtcagagggtttcagagaggcgctgcttcctctggtacctcgacagcgatggctgctctagaactcacaaacagaatggttcaaaccatacaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagagggaatcacagacacggctcagaccatttatgaaactgcggctcgagaacacgagagcagaggggtgactggtgccgtgggcgaggttctgcgccagattcctccggcagtggtgaaacctctgattgttgccacagaagcaacgtcaaacgtgctgggtggcatgagaaaccaaattaggccagatgtccggcaagacgagtcacagaaatggcgccacggggatgactgatggcttggaactgacagtgtgaagataaggagagtggaaccaggagctcagagtcctgacagcagcttcagaggaagctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatttaaaggtg

SEQ ID NO: 27501 - DNA, 2110 bp, Homo sapiens
cagctcggtgctgattatcacaactgtttggtgacctacttcactgacctgtgaggattccttcccttcaagtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctcgtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaaaaaaaaaaaaaaaaaaaaaaaaaaaaaaaaaaaaaaaa

SEQ ID NO: 27502 - DNA, 2090 bp, Homo sapiens
ggcctactgggagagcgcctgcgcggctgtcggttgatggggaggtcaggtctgggaaactaggccctggggttttccctgagcaggagcggtgcccgagggcctcaggcgtcagtccaggccctgaatggctggtctccagcggttggcgtcacatctgcctgtgggcgttatgctcccacataatacaacggaagctccagggccccactcagccaagcaagactcttatgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaagctgaagagacagaggaggaactcagaaggatccagacgcaaaaggaacaggccaaggaaaatgaaaacggagagctacagaaaattatactccccaggagcagagttaaaggtaataaaagcaacaccatgtacaaacctatcttctccccagaatttgagtttgaggaagaatttagtagagacaggagagaggatgaaacttggggacggtctcaacaaaattcagttccattccagttctctgattatagaatccagaggctcaaaagggaaaggctggtagcaagcaataataaaattcgagacccagtctcagagccatcggtggagaaattctccccgccttcagaaacaccagtcggtgctttgcagggatctgccagaaattccagcctgtccatggcaccagactcctcaggttccagcggctccattgaagagccacagctgggtgagtgcagccactgtgggcgcaaattcctctcgttcaggctggagagacactccaacatctgcagcaggatgcggggttccaagaggaaagtgtttgactcctccagggcccgggctaagggcacagaactagagcagtacttgaactggaaggggccagcttcagccaaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcatccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgcaaaaaaaaaaaaaaaaaaaaaaaaaaaaaaaaaaaaaaaaaaaaaaaaaaaaaaaaaaaaaaaaaaaaaa

SEQ ID NO: 27503 - DNA, 1881 bp, Homo sapiens
acacaggcgggtggggatcctttcaacagggctcccagcaatagagcagtcccactctcccagatgagctggagaagtagctacctctcccagacagagttggggtcaaattcatgcacatccaattcccatcaaagcctactcttcccagggcttgctgggagggaaggataactgcaggctcccctgggatgcccccaggtgagggaagttcacagagtttgagacagaggtgaatggacaggtgtgcttcttagggaagcagtcgagaggtggcaagaagttggcagctgccctcaagagggtcctggcaccatggacaatgacaagcctcttcagcctgagacagaagatgagattgaaattgagccagtacgacagagcagcgataaaatgctctactgtgaggccgaatccccgccgactgttgaaaaagtgaaaccagcctgggagaattcggaaacagacctggagattgaagtttccccaagaagggaagcaccgaaagagaacacttgtgaagcaagagaatgacgctggttccatctgacaggatgatgagaaatttttcaccactggacaaaaggagctgtacctggaggcctgcaagctgatgggtgtagtgcctgtctcctacttcattcggaacatggaggagtcctacgtgaacctcaaccaccacggcctgggccccaggggtaccaaggctattgctatagccctggtgtccaacatggctgttaccaaactggagctggaagacaattgcatcatggaggagggcgtcttgagcctggtggagatgctacaagagaactactacctccaggagatgaatatttccaacaatcaccttggtttggagggggccagaatcatctcagatttctttgagagaaacagttcttctatctggagccttgagctttcaggaaatgacttcaaggaagactccgcagcactgctctgccaagccctgtcgaccaattaccaaattaaaaagctggatctcagtcacaaccaattctctgatgtaggaggggagcacctgggccagatgctggccatcaacgtggggctcacgtcactggatctgagctggaataacttccacacaaggggagctgtggccttgtgcaatggtctccgggggaagtcctccgactcaaccgctgcctggtctacctggatatcggtggcaatgacatcggcaatgaaggggcctccaaaatcagcaaaggactggaatccaatgaaagcctcagagttctgaagcttttcctgaatcccataaatatggacggggctattttacttatcctggctatcaagaggaaccccaaatccaggatggaagagcttgatatttccaacgtgctggtgtccgagcagttcatgaaaacgttggacggagtgtatgccgttcacccgcagctggacgtggtattcaaggcagtacaaggcctctctcccaagaaaaccatcttcttgttgacaaaccccatgaaactgatccagagctatgcagaccaacacaaaatcacgatcgtggacttcttcaagagcttgaaccctactgggacaatgaagatgtctgtggatgagttccagaaagtgatgatagagcaaaacaaggtccccctgaaccagtaccaggtcagggaggtgataaagaagctcgatgagaagacaggcatggtgaacttcagtttcttgaacacgatgaagccatagcaacaagtctggtctagaaagaagtctcggcgagaggagtcctcgcaagtcggatggtggcagggaggagagcaagaggtggctgaaatctcgatggacagatgctgtggcaggggctgggcacaagcaaataaagtctggcttggt

SEQ ID NO: 27504 - DNA, 2025 bp, Homo sapiens
atggctgaagtcccggaggattatgattccggcccagatgaagatggagagctggagcctgagaggcctgaactgcctggacttcataaattgtatgaaaatgccgaaccagacaccatggcaaaggcagactcgaagctaccagcagagatttaccaagagccacagccagagaccgaggaagaggacttcaaagagggggagccagacagtgctaagaacgtgcagctgaaacctggcgggacgtcccaggaaggaattgccaaggagtccaagagagacgtaccaagcgaaactgaaccagggatacaccaagaggtaaagtcggaaacatccagagagatgggagagtttttcaaagatttggaggcccctatggatgaaacgcataaagagtcagacctagagccaccagaggaggctaaaccaaatgttacagaggatgtgttcctagagtcagctatggaaacagatccagatccagtgccaccaacggaaaccatgtctgaggtttcgggggccacagtcagagagagaaatttagaattactagaggaggagactgaaccgggggttccagaggaatcacttagagtgcaacatgaagagacaggtctagagcctccagagcagaccaaacaagattttccaagtgagaaactaggagaatcacttgaagagacagatcttcagccaccaaagatgaccaaaccagagactccagaggagacacaaagagagtcaactgagaagaaaaggacagagccacccgagcaggctagactggaatttctggagaaggaaccaagaaagtctagtgaggaggcaggtctagagcctccagaagagactcaaccagaggttccagaggagatgcaaagaaaggcaactgaggagaaagggacagaactacctgagcggactaaaccagactttccagaccacaagccaagaaagtctactgatgagaacgttcctgagccactagaagagatcaaattagagtttcctgaggaagaatcaagaaaaacaaatgaggaaacaattctagaacaatcagaaatgatgaaaccagaaagtccagaagagataagaaagtcaaatgagaaaaaaaatccacagccaccagaggagactggtccagtgctaccacaggagatcaacccacaagttgaagagaaaacacaaacaaagccaactgagaaaattctagagttaccagatgaaaccaaaccaagggagacacatgtagaattttccaaggaagacaggccagaaccaataaagtctaagtattctgtaggaaacgatgagctagagcaccgtgagcctaaaagaggaaagttgtcactaagtgacaaatttagaaaagaatattacgcattaggatctctcagagaaagtgaagaatcaattggtacacattatgagtttttgcaaccactccaaaaattgcttaatgtcagtgaagaatgctcatactcagatccctcagagtctcagacagaattaagtgagttcgttcatgaaaaggaagttgtagatttgtcccaagagttgaaggaacgggtctctgaagatgacgaaacccagccagaaaaagggactgagttacaatttgagcatcttaattgggatccagaggaagttgcagagtggattagccagctaggcttccctcaatacaaggagtgttttatcacaaacttcatcagtggccgaaaactcattcacgtcaactgctcaaacctccctcagatggggataacaaactttgaggacatgaaggcaatttctcggcatacgcaggagctcctggaaattgaagagccattattcaaacgctccatcagccttccctatagggatattatcggcttatatttagagcaaaaaggtcatactgggataaaatctgattccttgactttatctgaatttgtcaaagcagcaggattacaggattatgctccagaaataactgcccctgaagagaatgaggaattaccttgcactgaaccatag

SEQ ID NO: 27505 - DNA, 1754 bp, Homo sapiens
actaagtggttagttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataaccgagccaactgggtgaccgtaggcatctgtttttccagctccacccacaagatccccaatgtgatgctactggcccatccgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggaaaaattgaaaaacattctgaagcctgggtgtttacaagatacaaaaagtaagagtgagttgaaagaatcctcaaaacatgtcaccatctcaaacataacactgacttttgaaggtaaaagatattttcaaactaccttgaccccagtagaaagtgaggcaaatacatccaaggagatgaaggataagacctctgaagaaaagatgcctgattttcagagcacagctctcaaggctgaagaatccaggagcttgagaactgaatcaaacacttcagttctctcccctcatatcaaatctccttctaatttcctcaaacttgtgcctcatctgtctgcccctttctcaagggaatgaatgtgaggaaagaaaagtaaaacagaaaaagacaaagttgatggaaaaacatgtaagacaaactaaagacatttgaattaaatgaactgacttctccacctttttttaaaatcagatacaaactactaaactaaaaagcaaacacagctcagggaaagacaatcagtgcaagaggaaaaccaagcagtgtcttctacgtggcagaaataaagcctatgactaatcattacg

SEQ ID NO: 27506 - DNA, 791 bp, Homo sapiens
actctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactaaagcaacaacagtgggtgcagtggaccgtttgacagacaccagcaagtacaccggcacccacaaggagctctttgatgagagtggcaagggcaagggcattgcgggacgggaagagatgactgacaacacaggctatgtgagtggttacaagggttctggcacctacgataagaagaccaagtagagaggagcttcatctcagcctgctagccccctgaccctgcatgtttaacaccagggagcttggaaaacaataaacatctgtgtgtgcagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27507 - DNA, 2190 bp, Homo sapiens
atggtgacgcacgccgctggcgcgaggaccttttgtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccgccgcccccttctccagtgctctcgaggagggtgcaccagggctgccccaccctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcaccaggcccgccccaccctgtgagaagccgcagcccgttctccattgccatttggtcctgccttccccagagctgctagcagctcggtcgaggcaagagtgactggctcagagagcgagctttgtggtattgataaatgaataaattagtatgttcatgttggaagtggctggctctgcagagtgatggacagcaggtggcatcttacattgtgatttgtggtgcacagttaaaacacttcccttcgtttcagaaggagacaatgtgaatacttggaaattatagtgaataagatgcctcccaaacttgaggaaaaggtcagattctaagagctaaacgttaagatgtaatgttccagaacaaagaggcccagagtcactgaacggggccccagggctcctagcttgagtgtaatctgagtcagcttatgaaaaggccccaaagaagaaagtggaatgtgtgctgggcacatgggacagccatggcactgagactttggaagtggccttgccagcgctgtcctgtctttctggcccacagatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctgggtagtatatacacacatacgcagagccttaggaattgtgaaaggccaatcaaaacttggggccctaatttcactctgcc

SEQ ID NO: 27508 - DNA, 4232 bp, Homo sapiens
gccgctcgcgcaccgcgccacgtgttttctcctcccgccaatgggcggaagcgccgcctgagcctgctcccgccccccaggctcgcctgagccaatcggaaggggcggggtgtgtgtgtgtctgtgtgtgtttgtgtgttgtgtgtctgtgagtgtctgtgtgtgtgtatgtgtgcgcgagggcaagtcgggagggggacccagctcaggactgggaggccctgctcgcaggtccctgggtcccggtggcggccggagcgcttgctccgcaggcagcgggcgggtggtcgcccctcccgcccccaccccgcgcgtgcgcgccccggcctctccctccccgccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacggggaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtatcagtccctcaatctaacccatgttcctgaacacagtgcacccatctatgaattccggtgacaacggttcagaacagcaaccaaataaaactgaacttggcaaaaaagaactttgccgagaaaattgtgtacctgccagaaccaggagaagtgtgttcctgtttcttcacgagcagactcgcatcacaaagcatgaatgttaacccacagaatccaaggagcatggctggcccgtggggcaggtggagggagcagtcttcgttcttcctcccctcagtggcagtttggtcttcacctgtttttaagctaccttaaacgcacttttccttcctgcacagctaacttctacatcactgaaatgcccattccttcctccgtcccacctccagccgaatagaaggtctgctcccggatcaccctcagccttggtgctcagtggtcccgaggccctagacccccaccccccgccagttgctttgtctggtagctcaagagaaggcagagccccagcacctctgtgccccccagagctctgtgcagggagttggccagctgccgcatcatcggccaccaagggcacaagaggcggaggctccagtccctgctgggctgcctcagtcttcagtgctgattgtgtcacgggtcagcgtgcgctgctgagccctgtactgttaacagtgcaaagctagtgagtagctgtcaggttccctgggcctgccatcagggatcactaaatttaaggcttccagatccctggcaggaacagattccagtcctgcttactcagtacatttgctccaaacttttcaacttgagggcaatactaaacttaaaaataagagtttttttattacaaaattatttttatggtccctttaacgaggaccctatggcaaatgcacaattattcagaattacattttatcgttttcacattgaaaacagcaaatgttgacttagtaatttttatatcgatatctatatgtatatgtatatttaatcaaccagcagttttgaaactagtcatcctggtacaaaagttttgcagcattgcctaaattatagtgctcaacacaagaactgtttttggggccagtttagcatttgtgccgcctccttttgctactcaaaacagcaatgcttggcggcagccttccatgaggcagaaggggtcgtcgttctctgaaaacagtgactctgaaatgttgggacaggggaaggggtgggaaacatgaacatgctcaaataactcgaggctcacgtgccaaagtgtgtgtgtgtgtgtgtgtgtgtgtgtgtgtgtatgatgttttgtttttttaaatgttttaaaagcttaataggttggcatcagttgtagcccacaaacatggctagggctttggggatttggcatttttctggtggtttacaagacttactccgaatacaagaggaaaagctttaaaaacaagattgcatcataacccccaggagcaaagcaacctggaggctgcatatccatgggcgggcagcataagagaatgtgaagcccttcagtgagacgagacgagcaatgggaaaccttttctgttcttaagaagtgactttaattttattgacatatgtactgtatgttactgagattgaatgttaggggaagccttaaggtagaggtatttgggaaagtagccagtgggcacttgtgatatctaaaatctgttatcccaggactgtgtacagaggggcaacctacccattcaggaaggtcagggctttggaaccctaaaaagttggcccgatgacttaaagggaaaaataattcattcccagagatgagtcagaacagtctcctcaatcctgaaattcaacaaggcatcagaagggctggctgtggtcaagcccagctgctgtcatgtgaggagatgctcactgtggtcttgttgagctgatggccttggttgagctgatggacaagtgaaggaggccatggggctgtgctgtccttcctgccgtacgtgccattccactctcttcagctctcccctcaacagcatgcgagcccataccttctgcatttttccaggcctgtgagggatataggcctccccttggagcactgagtccggaggtcatccctgagctcatccacggctcatgctgtggctccgagtagtggtttgagtgggcaggaagggccatttgcaaacactgctgtgttctagacaaacaacccaagtcctatggcaggatttcttccttccttccttttttacccaggtgatgaagtgcacccattgtactgggaagaatgaagaggtgatacctttactagatccttcagacacatctatgagaagatttgttcatttaaaagtctgcccactgaggatagggaaaggattaaggatttttccacctcctcttagtaactcctgaattaccaacatcaacttctttctctccgttcctgaaggaactttggggaatcatcttcatccgtagttacgctttcctgaaccttctcagtggtttacatgcctctgaaactatgtgcaatatttttggttgacacttgtatccatccttaagaaattagtgcagattgcagatgttctgtcttccatcccaaacaagcctgccatgaggtaggatcctaggggtttggctgttcttactccactgctcagaaagcttccattctgctgtcctcagcctcgaccctcttctgtgctggacttccacccacccacccttttcaagtttagatagtgtttcagctgctgtcccaaagtaacaaaacaatacctactgttaagtaggaagtcaatctgtgtgctggttttgttggttatgtggaaatcacaaactccagaggagcaaaggggtttttcaatgtcttttgctttcagaaacagagaatataatattctcactaaggccttgaattgatttttttctcataaaatagtctgataagctaatttttaaaaagaaatgccattaactgtgttgtatcgtggtttaaaattactaacaagttgtgggaaagaaaaataatatttgattttgaatcttaaatgtttttaaaaattagacttgaatgggcacaaagtataaatattttgtttctttatggaggacatgtggaaggagtttgagggtttgggatgggagaagtattttgcagagctatcaatgtccaaataatttaaaaaaaaaaataaaggtatttaagcagtg

SEQ ID NO: 27509 - DNA, 971 bp, Homo sapiens
ctaggtcacagaagcagtgggtcagaagccagaggggacgtggggagtgccaccctggagcctaccggcacacctgctgagatggaggcctcagatgggcaagggggtgaaggggacaagccactagagcaggtgacaaatgtgtcatgcctggagacaagctccagcgccagccctgctagagactcgctcatgcgccatgccaagggcctggatcaggacaccttcaaaacttgtaaagaatacctaagaccgctgaagaagttcctgcgaaagttgcacctgcccagggaccttccccagaagaagaagctgaagtacatgaagcagagccttgtggtcctaggggaccacatcaacacctttctgcagcattactgccaagcctgggaaatcaaacactggagaaagatgctctggcggttcatctccctcttctcggagctggaagcaaagcagcttcgccgactttacaagtacaccaagagcagccagccggccaagttcctggtgacattctgcgcctcggatgcgccggagaggtccttgctggccgaccgggaagacagtctgcccaagctctgccatgcatgggggctgcacagcaacatcagcggcatgaaggagcggctgtccaacatgcagaccccaggtcaagggagccccctgcctgggcagccaagatcccaggaccatgtcaagaaagattctttaagggagctttctcaaaaaccaaaactcaagaggaagaggataaaggaagccccagaaactccagagactgaaccgtaagaagaccaactgggacaaagggcccgcttgtcctggctctcagagcacggggaatggagaccaaaaagggaaaagaattgtccttatcaaaaagattctcaggtcttaattaggaataaatgaggtgggaaataaaaaaaaaaaaaaaaaaaaaaaaaaaaaaaaaaaaaaaaaaaaaa

SEQ ID NO: 27510 - DNA, 2144 bp, Homo sapiens
ggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaagtttctttgttggaacgaagctcaactcatataaggagtttggaaccccctgccggacttacaacctccaacttctctctaatgaggctcttgggagctgtacaaaaaggctggatcaggtgcaacaccaccataaggaagagtggattcggtggcatcactatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcaaaaaaaaaaaaaaaaaa

SEQ ID NO: 27511 - DNA, 1358 bp, Homo sapiens
aatgtatgcaatgtctttatttcatcctcattcttaaaggatattttcatcagcaacaccacaccctcctgatcaccatagctttatggtaagacacccctactctgtccagacccaactgtcaacagaagccaaagccatctggaggagcatgcaacaacaagaaacaaatttattagctaacctaaccactaatgacgcaagagacaattctaaggactttcaaaacagcaaagtaggagcagctgctacctctagggatgagggatgcaattgtccaattattggtgaaattgtcatttcatgctattggctatttgaaattcctcctctaatttcagaataaatcactgaaattgacatcggccagtctgaatttcaagaaattacctgctgaagacaagagggatctcttcttcagatttgcagtctggggaagacacagcctctactgtactttagaacctgagatatggtggtggagggagccctgggtcgagtggtcagagctccggactccagccccatgcaacttcaaaatatgacaaatgtcttgaaggggagattggcatgcagatgaggaaggccctctcgccaacacatttgtatttcctctgtactgtgagactgtgggagatttactgcgacatttagaagctttcttccaaactcctgggcctccgacactggttctaaactcagcaaatgttctttgggaaaaacagacagtgcatgtgaggcccctcgagtttggaatttatgtctccagcttcacatggtctctcaagtgcttatgcttttcttctctctgccacccacattcccacatcccgcccaccccccaactttcctcccttcaccttcccatggagactttttgcctgggctaaatctgatcctcagcccactctcagaatcgataaatgcccctaggtgattgtaagctcacctaagatatactttttctcctctagaattttagtttattagatttttctagttgtctttgcaaaagcgttaacaggctctgacttctgacattcaactagatgtggaatatccaacccctagcatttcatggaatgtactgaccaagataaaatgtgttcttattaaacaatgccatttcttgaccacttctgtttttaggaattgtggtatctgagtcatggtgattagaagtactaatgaaataaatgggaaaattaaacttctactaacatttcatatagtagggagatgtctgtgaagaattataactggtacagattttgtgtttataaacaaggagacagaaaatgcagaaaataaaaaatattttatttagtcaaaaaaaaaaaaaaaaaaaaaaaaaaaaa

SEQ ID NO: 27512 - DNA, 5016 bp, Homo sapiens
taacattctgttcttccgcgtgatggattttcttttggagattcgaactgaagcctgtacggaggaaatgttgtttttaagggaaatgaatagaaacaatccactttgaagaagccatggcgaaatcaaagacaaaacatagactttgttctcaggaatcttcagtatctgccctgctggcaagctgcaccctgagtggtagtaattcctctaattctgatggctcgtttcactataaagataagctgtacagatctgcttctcaagctctacaggcttatattgatgattttgatctaggccaaatatatcctggtgcaagcactggaaaaattaacattgatgaggattttactaatatgtcacagttctgcaactatatttacaaaccaaacaatgcttttgaaaaccttgatcacgaaaagcactcaaacttcatatcctgtagaagacacatcgttaatgacatagactccatgagcctaacaactgatgatctattaagactcccagcagatggatcattttcttatacttatgttggaccgagtcaccgaacgagcaagaaaaacaagaaatgccgtggaaggctgggttcattggacattgagaagaatccacattttcaaggaccctacacttccatgggcaaggataactttgttactcctgttatacgctcaaatataaatggaaagcaatgtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataagaccacagatccaaaagaagagattaaacaagtttcagaagatgatttctctaaattacagttgaaggaaagtatgattcctattactaggtcacttcagaaggctttgcaccatttatctcgcctgagagacctggttgatgatacgaatggagaacggtcaccgaaaatgtgaagaggaaaatgaaactgtcaccacgataaatagtcaccacagaacaaataggcattttttctattacttaaactgacaaagtaaatataagccatacattattttgtggttggttcaaggattatatatttctaaaacactaaacttgaaaatacccataggttttgggacctatctttattttgtgccaacatactagaatgtgaactgcaaggacccacaatgtatcctgaagtcttactttcgccttctggccagcaaatgtctaatatttaaagatggatgacttctgttcttgaagcttacctggatttaaccttcttcagcatcctcaacattttattacctggttcaggatcattaagaaacttactggtttttatccaaaatcttttacgttaaatagacttttttaaagatatagttagcatcacttttaaacagcttaaaggaatatcaaaattgttattgtgtatctcatctataaggaagtctgttactttgaaattttcataaatttaatatttaagatacattgtatttgaaaattgcattaatagtggggtgatactgtgttaaaaggaacgttgtgttgtgacattcaagagaacctcctcatttaattagtactttgattctgtgtaagataatcttggtagtgcttgacagtttccaaacctttttttggagagatatttaagaatttaatattttgatattagattgtttcccagattttaattttggggttggctcaaactagtgaaaactatgactcaatggccaattgctttatcaaatttgataactaaaacttaaaatgaatatggaaaatcagaaagcaactctattttagagctattttgtaagagttgtgctttctttaacaccatctgtagtcttaagtttgtctctagctagaactgaacaaagctctataatttttaccaagcacttattattaatacttcttataagtagtaagcatctttactaacacaactgagaattaagtcataaaacataactaatacagcacattactgcctgacaaaattaaagagtactgtgtgtatgtataactactacaggttaacacttcacccaaatgatagcgtttttcctcagtagattattgtcaaataggaatttctaagcacattgagtcaaagcattttttccaggttaataaagtgttatttactatctttgttagaggtgacatgtcaaacactacagtgagctctgtggggtttttttttttttttttgcccgtgagttttttaccatgctgctctgaccagtttgagtggcaattaccaatagatttgttttctttattctatggagatgtttttaccactgacactgttttctgattatagtctgcttcatagaaaatagcctgcataatcaaacaaggagttactttgaaattaaagtatgcctggctattaaaaatgcagattttaggtgggtaaacatcaggtaggtctgggtgggtcatgttctaggcctagaaaaatacactattagacaagttctaaagaaggcaaggagataaaggcatcaggtggtaacttctaattgaatattatatgttgatcatacataatatatactatgcctggaaattatgactgaaaagcacctattcggttagtgctcctattcatgagaacatatctccaatactaaatgagataagcctgttctaaaatcttatagccagtattttaagaaacttgattatacttaccaaaggaacattgtttgttttctcttgttttaaatatggagaggtttaatcctttacataacaaaggaattaattttagcaaaatgattcattccaaccttcttataagaaatatctaggagagtcaagtaagaaaaataacgaatctaagtgataaacattcaagaaattctctaaataagagatttatttataattttaatatctcagggttctttttaggtttccaggggaaaagagcaggataacagtgtggagactgctaagttgagaatttaaaacaaatgagaacataagatttttaaaattgcattgtgaatgtaaaatttttatcaatcctttgctcttttagacatattgagaaaatgttaaatagaaaaaattaagaaattttaataagatgtttcagatctttgagtatgaaaaacataacaaaaaagcctaatttcaaaaaactatttgagatcaagggacaatggtgtgaccaatatgaagggtcaagactgaaatgtattgtctttactatcaagaactctactttcagttgtttctcagacagttaatttcagcttcatagagatttctgagcaaattaagaaacactgttttcctgggtttgttttgggtatatgtcattatagttatgttatttcttgttgaaatttataattgtaggttttttgtattgttttggtatttaatggtgtataatgtgttattacattatatgtagttataccaaaatattgcctgaagagaaatcatgacaaggtcccctgtttattcctgtgttacagacgcatggaattgctcctgtagatttgaatttttgtttcatttttttctgtcccacccttcactctctctgtttcagaacatttttggtagaagtgctatccagaagtgaacttgtcaaaaggcaagtagcatgaaagaagacagaagaagcaaaaggctaatacagtggataatttctgagcacttgaagtttcttcaaatgtgcaagactgtgtgtcttcctattagatgtataaattggatatttcatgcctaattaaatgttgcgttggattgcagtgcctatcatacagtgattggagtaaattgaggcctaatcctgaacacatatagagcatattgttagatatttttcctgtgacatttgaagttattattctcccatttcctttttctttttttgtttataatcatatgtccctaagattgttttccttttttggaccaaaaaaaagaaaaaaaaaatcttagcttttcatcctcccagtgtattctgcattgtccttaccctagatcagccccttctgtgtaacagtttttctcacaatgtagcaacttttatccacccttcaggaccttcactgggactagttcattcattttcaaatagctatttcaacctttaacatctactgtcttagtcttttacacagaagccagagtgactggtcttggcaagactctgttgtgtatcaccactctaaccttactgatttgtttcagcaaatttgctttagttaaattgctttactcagattcccccaaactttatatgtgtattgtcatctttgtgcatattatttctcatgcatgaaatactcaatttttattcttttatctaacgcttactcttacatttctttaaagctctggccaagtattttatttcgtccctaaacattctaactatccaccaaactggtaagttggcttttctttttcctccccctgtcattcatttagctgttatatttcattttaatgttttgggtggtgcctcttatactatgttgtattcctagacaaggaaatgtatatcaaaatatgttagatgattgattgttttatctccttgatgatagcacctcttatactgctttacagaatcaggaaaaagtaaactgcattttacatagtggttttaaatattgattgattgatattctaaacctggtttcctatataaagttgtaagttcaagataaaaaaaaaaaaaaaaaaaca

SEQ ID NO: 27513 - DNA, 3500 bp, Homo sapiens
aagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccggggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagg

SEQ ID NO: 27514 - DNA, 1502 bp, Homo sapiens
attgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagatgaatggacagaggtggacagaaaacgagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttgaaaaaaaaaaaaaaaaaa

SEQ ID NO: 27515 - DNA, 782 bp, Homo sapiens
attgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgaagagagtgcttctggaagcatatgcaagaaactgttcacagtgcacagtgttgccttccaggagtggggaactatatggaggacaggagaaggagactgactttccattatgtatacccttttgagaactttgagttttgtacctgggcaaaataaaattttaaaaaggggaagaaaaaaaaaa

SEQ ID NO: 27516 - DNA, 1968 bp, Homo sapiens
acagaaggcggggccagcgccgctgccgggtgctggaggcgccattggagccggcttggctggcgagcccggctgaggagcctcttgggtcgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtatcaggtttgacctcaagagatggccgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaattttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctgtatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcagtagaatcacttgaaccctggaggtggcggttgcagtgagcacagatcatgccactgcactccagcctgggcaacaaaacgagacttcgtctc

SEQ ID NO: 27517 - DNA, 2363 bp, Homo sapiens
ccctgtcctgagcccaggcgttcgccctgtcccacctagctctgagcagcgccccccagcaccctgacatgcgtccgcaggaccccgcgctctacccgcaggccccgcaccccctagctctgggccgcgcctcacatccctcccagagccgcaacaccccacccgcgggacgccctcgagcagccgctcgttgcgggcctgaacgcagagcgcctattggccagagcggccgagggcgggaaaagtggccaacggctgcctcggccctcgggctgctgaggagatggcgtcgggcttccaaggcctcggtgcccgcggactcattccgcaccatcagcccggacaggcgaggcgagaagtccgcctccgctgtctccggggacacggcggccgcgaccaccctgaagggcaccgcgatcccagtgcggtcggtggtggcctcccctcgcccggtgaaggggaaagcgggccgggagacggccaggctgcggctccagcgcctgcccgcggctcaggccgaggacacgggagaggcggcggcggcggcggcggaggagcccctgctgccagtgcctgaggatgaagaggaggcgcagcccctgcccccagtctgcgtgtcccgtatgagggggatgtggcgggacgagaaggtgtcgctgtattgcgacgaagtgctgcaggactgtaaggcagaagatgctgatgaagttatgggtaaatacctatcagaaaaattaaagttgaaagacaaatggcttggagtctggaagactaatcccagtgtattctttgtgaaatatgaagaagcttctatcccttttgttggtatattggttgaggtaacttgtgaaccataccaagactcatcatctcgtctcmaagttactgtttctgttgctgagcccttttcttccaacattgcaaatattccwagagatttggttgatgagattttggaggaactggaacacagtgtgcctcttttggaagtgtatcctgttgagggacaagatactgatatacatgttattgctttggccctggaagttgtcaggtttttttatgactttctttggagagactgggatgatgaagaaagttgtgagaattatactgcacttattgaagaaagaattaatttgtggtgtgatatacaggatggaacaatacctggtcctatcgcacaacgttttaaaaaaactttggagaaatataaaaacaaacgtgtcgagctcattgagtatcagagcaatattaaagaagatccatctgcagcagaggctgttgaatgctggaaaaaatactatgagatagtcatgctctgtggattactgaaaatgtgggaagatttacgcctccgagttcatggacctttctttccaagaattctgaggcgtaggaaaggaaaaagagaatttggaaagactataacacatattgtagcaaaaatgatgactactgaaatgataaaggatttatcttcagacacacttctccaacagcatggtgatttggatttggctttggataattgttatagtggagatacagtaataatttttccaggagaatatcaagctgcaaatcttgctttgttgacagatgacatcattataaagggagttggaaagagagaggaaattatgattacttctgaaccttctcgtgacagttttgtggtgtccaaagctgacaatgtgaaactaatgcatctatctttgatacaacaagggacggttgatggtatcgtggtggtggagtctggtcacatgactctagaaaactgcatattaaaatgtgaaggaacaggagtgtgtgttcttacaggggctgctttgacaattacagacagtgaaataactggcgcccagggtgctggtgttgaactgtatcctggaagcatagctattttggaaagaaatgaaattcatcactgtaataacctcagaaccagtaacagttcaaaaagcaccttaggtggagttaatatgaaggttcttccagcacccaaattgaagatgactaataatcatatttatagcaacaaaggctatggagtaagcattcttcaaccaatggaacagttttttatcgtagcagaagaagctctcaacaaaagggcttcttcaggagataaaaaagatgataaaatgctcttcaaagtaatgcaaaatctgaatctggaaatgaataataataagatagaagcaaacgtcaagggggatatcagaatagtcacaagttaaagcgtctgaattgatgttaaagttttatatttcacaaatttgtttaatacatgattctcataccccactgaaatggtagtttcaattcaaagcttaattaaaaaatatttaaatatc

SEQ ID NO: 27518 - DNA, 4367 bp, Homo sapiens
aagcctaggtaagctgaggggcagctctgggaaagtcctaggggtgggggcagtctccacagcctcccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccattccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgtgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttatgcccttggggttcccggcgctggggcttctgctggggagactcatccttcacattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctcaaaaaaaaaaaaaaaaaa

SEQ ID NO: 27519 - DNA, 769 bp, Homo sapiens
agcggagggggatcgcttgaacctgggaggcagaggttgcagtgaacagagatcgcgccactgcaacccagcctgggtgacagagcgagactttgtctcaaaatataaaaagaaaaaaaataagggatcttccaaaaggaaaaggtgaccagtcgagaaatctgggaaaacccaactggttagtgggaaagagtacaacgccggggacacggagggaacgattacatctaagatcagtgagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaaaaaaaaaaaaaaa

SEQ ID NO: 27520 - DNA, 3816 bp, Homo sapiens
ctcaagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgaaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggaaagttctcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaacttcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacaaaaaaaaaaaaaaaaaaaaaaaaaaaaaaa

SEQ ID NO: 27521 - DNA, 1050 bp, Homo sapiens
ggggacacaaaggggtggtcaccctgccctcaccttgacctgtaagttgcctaggacagtggcctggtcccaggggctgttgtggggagttgaagaacaccctggcctcctccatcatgtcggccaagagggcagaattgaagaaaacacatctgtgcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcgggggaacattccttcagaggcctcaggcctttacaaaggtggagaggagccagtgaccacccaaccttctgtgggccacgctgtgcctgccccaaagtcccagactgagggaaggtgaagcttaactgccagcttgaaatgagagtaaagaagatacagagcaaacagtgtttcagaaactgtcctgccctgggtgtgattctttggcttcaatttgaaggaggaggaatgatgggatttcatattttatttcacaccagttcctccttgtttcatctctttgctaagctggctgcttctaccatctaataaataattggccaagttaaaaaaaaaaaaaaaaaaaaaaa

SEQ ID NO: 27522 - DNA, 2654 bp, Homo sapiens
agaatatcaatttggattctacagaaaggttctgttggattctgagcggaacctctttggatgtgcctttggatttcaagattgagccaagtgttgacatgggaagatgctccagttcctccagttatctcaaagaagctcattaccttgctaaggaatagcacacagtgaagacagtcagtgagaaccagagctattgttacaactgacagcagccagctcaggaggcagaggacgagagcgatcgggctgcacacacatggatgaggctgatttttcagaacacacgacttataagcaggaggatttgccttatgatggggacctctctcagattaagataggcaatgattacagttttacctcaaaaaaggatggccttgaagtcttaaatcaaattattttcatagcagatgaccctcaagagaaggctatgcatagtgagacttgtggaaatacagctgtgaccatacccctgggtaaaattactgaaaatgctgccaacaaaaaagacgagaaagagaaacaatgcactgcagctcttcatattccagcaaatgaaggagacgcttctaagtcaagcatttctgatattttacttcatcatctttccaaagagccattcttaagaggtcaaggcattgattgtgaaaccctcccagagatctcaaatgccgacagttttgaagaggaagctattattaaaagtattatttcatgttataataagaattcttggccaaaagaacaaaccccaggactcactgaccaactcaacccgaaaagggatggtgaaaacagcaataagcctggttctgccaccacgacagaggaaaatacctctgatttagaagggccagtggctgctggagatagcagccatcaagaaaatgtgaatgttctaactaaaaccaagggtccaggtgataaacaaaaaagttatcaagggcagtcaccccagaaacagcagactgaaaaagcaaattcaggcaacacgttcaaatacggccaaggtcaagttcattaccagctccctgatttctctaagattgctcccaaagtgaaaattcctaaaaataagataattaataaaccacttgcaatagctaaacaagccagcttttcttccaagtcgagagataaacccactcttgtgcaagatagtctagaaaccacgcctgagtcaaactgtgttgaaaaacaacatcaagagcagaaagggaaaatcactgaaccttcacaacaaatccagatggagcccatagtacatatccaccaagaacttctcacaggaatagaatctgaggcaagtctctctaagttgtcaccaacctctcagaaaggcacttcctcaagttcttcttacatatttcaaaagatatcccaagggaaacagatgtgtcagaagttgaaagaacagactgatcaactgaagactaaagtacaagaattttccaaaagaataaaacaggactctccttaccatttgcaagacaagaagctgtgacttcaccgctgcaggtcctggagaaactgcagggacaccttgaactgctggagcagaactttctggccaccaaggacaagcatctgactttgcagcagcaagtccacaagcacgaatcaacaatcgttggtgactttgatccagaaagaaaagtggaaggtgaaatcttcaaattggagatgctgcttgaagatgttaaagagaaaatggatgaaagcaaatatacttcagctccttcccttcctgtgagttctccagttaccctggatgacttggcctccaccttctcttcactctcaaatgaggtaatacagcaatgtacagtctaattttgtgccaggaaaaatggtgtttttgcatttatagactcctaattcatggattcactgaattccatttttaatatctcatgaaaatttaactttccaaagtcccatgaattatattattttaaatggaaccagcttttaaagattagaagctatttcaagtgttaatttttgaaacatctttatagtttaggatgtaacaatgctgtttaaatccattaaaccaccgaagagctatttcttccaaattaataagaaaatttttgtagatcatgcctggaagaaataattttttttcttcatagttttgtactcaccaggctggagtgtggtagcacgatctcagctcactgcaacctttgtctcccgggctcaagtgattctcctccctcagcctcccaagcagctgagattacaggtgcatgccaccactgcctggctaattttttatatttttggtagagatggggtttcaccatgttggccaggctggtctcaaactcctgacctcaagtgatccgcccgcttggccttccaaagtgttgggattacaggcatgagccacctgaaaataaagaatagcacactcagtgaaataattatttcccatgaatccacttctgcattttccttctctcaagttaaattcttttggatttctacttatgcaagattgggaattcaaattaaccaccactgtctttctatactttttgcctttgtagcctcaactatcagaacattcagactaaaatcaaaattctgagaaacagaatcatttaaataaataccttaaattgacaaaaaaaaaaaaaaaa

SEQ ID NO: 27523 - DNA, 2061 bp, Homo sapiens
gggaggtctcaggccccttgggcagacgctgcgcgtgcccagagggagggatggcaggcttcagccacttctcccagccgccctaccgggatctctgggaacccccgcggcccggcggagaacgagagtccacgcagcggctgggcgggcagaggtccggagccgactccaccgcgtgctcccgggccgggactccgggtgcggagagcgaagctggggcgtgctggctgcacccgcactgttcgttcaccccgcggcctcgcaggcgcgggtgctcagattcactgcggggcagccgaagcctgagcgatgtggcccgcaggcccctggaacgttccaggaagcaccggccccgcagcaggcgcctggaagatgcctggggagagacaggaaccaagccccgcccggcttggcagccgcagacccagctgccaccccagcggccgcagccctgcccgcattaccctctggcccagggagactcgcccccgccttgccccggaggagctggcactcccctgagtggcacattcagggtagaaaaggcacagggtggagaccagtgggcagtgccactcggcagacatctaggtcgctggtccccttcctcagttccctcggagcggtcttctgtgccctcgcaaaagttcaagaggcactcagcctgcgtgtgcgcccagaagagagacagcagcgaccaggttgagtcattagccagccgggactcccagcccttggcctccagcaaagagatgcggagcccgcacacccaggtcctgaagagcaagctggaagaggtggtggtgtcctcccaggaccagcagattgtggccctggtgctgacccgtctcaagaaggcccagaggatacgggagctgcagcagcaggcggctaaggcctgggaggagctgaagcgctcggatcagaaggtccagatgaccctggagcgggagcgccggctgctgctgcggcagagccaggagcagtggcaggagaaggagcagcgcaagaccctccagagccctgagcagcgcgacctgcggcgggacagccagaggaagaacgtgcccccgggggaaagccggtggaaggagcaaccagaggaccaggagagcccgcgccaggagaagctggagaaggcgcgcgcccaggcagagcaccgaaaacagtgccaggtgcggcgcctgctggagcaggagaagatgctacggaacctccgggagcagcacagcctgcagctgcagaggaggctggtggaagcctgtcgcaagaggcacctacatgccgtggagggccagaagaaggtccaggacaccaacctgagctccctcatcaattaccaggcccggaaggtcctcatggactgccaggccaaggctgaggagctccttaggcagctgtccctggaacaaagtttccagcggtcccaggagatacaccagggcctgaggaaggagcggcaacgcgagctgagggagaaggcccagaaggaggaagagcagttgcagcaggccaggtggcgcgcaggggagtcagaggaacagaggaagatgcgcaaaagaattctggtggagctggcggatgagaagatccgacaggccaggagtcacgtgcacaagaccactagggacaaggtgcagcacctccgggagctcaaccacctgagggagaaaaaccaccacatcctgaaactgaaagccgagaaggaggaaaagtgtcacattgagggcatcaaggaggccattaagaaaaaggagcagagggtgcagcacatttcccaagggaaagacccaaacttccaggagttccagaagctccctcaggcctccaggagagaggagagagcgcctcccaacagctcccttgatcagatggtactagaggcccagctccgtgcctgtcagcagaacaggggttactgagaaccaaggacgcctggcttacagtgcgcagccagaaggagatgtggcaatgtgattccttttgtaatctgattataattgaacattgattttaaaaaagcatgtaaaatagctgcaatttccaaaaaaaaaaaaaaaa

SEQ ID NO: 27524 - DNA, 2927 bp, Homo sapiens
cgcgtgcatcagcctctctggcgggggattctccccggactccggccagcgccaatcaggtcgcgcggtacctgcccccagccctggccacctggaggggcgatgaggctccacgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagccgcgggactgatgcccttggccagacgcacccccaactgctgtctgctcaggtgtagcccgcgtgactgagtcaccgctgctccagctgtttcacgtcgccgttccctttactgaatagtttgatggggcgccgggcggatgacagcgggaacggttgtgatcactggcggaatcctagctacggtgatcctcctctgcatcattgccgtcctgtgctactgcaggctccagtattactgctgcaagaagagcggaaccgaggttgcagacgaggaggaggagcgggagcacgaccttcccacgcatcccagaggccccacctgcaatgcctgcagctcccaagccctggacggcagaggcagcctggcgcctctcaccagcgagccctgcagccagccctgtggggtggccgcgagccactgcactacctgctccccatacagctcccccttttacatacggacggctgacatggtgcccaatgggggtggaggcgagaggctctcctttgctcccacatactacaaagaggggggacccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaaaaaaaaaaaaaaaaaaaa

SEQ ID NO: 27525 - DNA, 905 bp, Homo sapiens
aaaacaaaaacatgatggcctctcccagcaaagctccagggttggaaagagtcccctggcagggaattggcaccccgtcgtgcccatcctctctctctgactgcctgctggaaatgcccccatctccctttgagtcctcctcccgggcaacccctgtgacctgtaacctctgtcctgaaatcatcacaatggccagagtggcctcagctcagggcctctgtgacatcaccaagggcctggcaccaggtgcccagtctcccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgcaatacggagagcactttcggattcggcagaatctaccagagcacacccaaggctggcttgggagcaaatggctctggcttctttttgttgttgtgccgtttgtgatactgcagtgtcaaagagacagtgagaagaataaggagcagagtcctcctggccttcgaggcggccaacttcactctccattaaagaaaaaaagaaatgcttcccccaacaaagactgtgcattcaataccttaatggaactcgaggtggagcttatgaaatttgtgtccaaagtgcggaatcttaaacgtgccatggcaacaggtagtggcagtaacctcaggcttcgaaagtcagagatgcctgcagatccataccatgtcacgatctgtgaaatatggggagaagaaagctctagctgaatggatttgtgtgtcaggagagaaaaaagttgagtgttgacaaactgtatgcaaactaataaaactattctg

SEQ ID NO: 27526 - DNA, 1791 bp, Homo sapiens
agtgagaccccatctcaatttaataaataaataaggaagaaagagggagacagtagctgctcaaatcatgggtgggaaagctgggcctgggagcgtttagctggtggggtcttggcgaaggcgggggacgggcagaaccttgggttcatcatctctgggaaccctttgtgcacccatcacctagcaacaggatgcagccttccctcggccctggaaggccaggtcacaaaggccatcagggcttgtccgggagccggtatcccctaagactgccctgtgcctctcgcggcgatcccggcccagcggctgggcgttagggccaccgctcatgtgcgtcatctgcttcgtgaaggcgctggtgcgcgtgttcaagatctacctgaccgccagctacacctacccattccgcggctggcccgtggccttccgctgggatgacgtgcgcgccgtgggccggagcagcagccaccgggcgctgacctgcgcggcagccgcggcgggcgtgtggttgctgcgggacgagacgctgggcggggatgcgctggggcggcctccacgtggggcgcgcagccaggcgcagtgcctcttgcagcagctccgcgagctgcccggccagctcgctagctacgcgctggcccactcgctgggccgctggctcgtgtaccccggctccgtgtccctgatgacgcgcgcgctgctgccgctgctgcagcagggccaagagcgcctcgtggagcgctaccacggccggcgcgccaagctggtggcctgtgacggcaacgagatcgacactatgttcatggaccgccgccagcacccgggcagccacgtgcacgggccgcgcctcgtcatctgctgcgaaggcaacgcgggcttctacgagatgggctgtctgtctgcaccgctcgaggccggctactccgtgctgggctggaaccaccccggcttcggcagcagcactggcgtgcccttccctcagcacgacgccaacgccatggacgtggtggtcgagtacgcactgcaccgcctgcacttcccgcccgcgcacctggtggtctacggctggtctgttggcggcttcacggccacctgggccaccatgacctacccggagctgggtgcactggtgctggacgccaccttcgacgaccttgtgccgctggcgctgaaggtcatgccccacagttggaaggggctggtggtgcgcaccgtgcgcgagcacttcaacctcaacgtggccgagcagctgtgctgctacccggggccggtgctgctgctccgacgcacgcaggatgacgtggtcagcacttcgggccgcctgcgccccctgtcacctggtgacgtggagggcaaccggggcaatgagctgctgctgcgcctgctggagcaccgctaccccgtcgtgatggcgcgagagggccgcgccgtcgtcacccgctggctgcgcgctggcagcttggcgcaggaggccgccttctatgcacgctaccgcgtggacgaggactggtgcctggcgctgctgcgctcctaccgtgcacgctgcgaagaggagctggagggcgaggaggccctggggccacacggacccgccttcccatggctggtgggccagggcctgagctcgcggcggcgccggcgcctcgcactgttcctggctcggaagcacctcaagaacgtggaggcgactcacttcagccctctggagcctgaggagtttcagttgccctggcggctgtaacctatatgccccagtgggggatcacgcacttgaactccaaaaaaaaaaaaaaa

SEQ ID NO: 27527 - DNA, 1927 bp, Homo sapiens
agctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggaagatggagctgtttgcatcatggtctgatgagaagctctggcagctggtagccatggcgaagatagagaggttctcgtatgggcagctgatctcaaaagattttggagagtcacccttcatcatgtttatcagcaagggcagctgtgaagtcctgcggctgttggaccttggggcctccccttcctaccgtagatggatctggcagcacctggagctgatagatggcagacctctgaagacccacctgagtgaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctctccaagatgctgggcccgaagatccaatccaggcctgctcagtcgatcaaatgtgccatgatcaatatcaagcctggtgagctccccaaggaggctgcagtgggggcctacgtgaaggtgcacactgtggagcagggagaaattttggccttccttccagagggtgaatgcgacacacgacccttgatcctgatgagcctgggaaatgagttgatacggataaggaaggaaatattttatgaactgattgacaatgatgacgagatgataaaaaagttgttaaagctcaatattgcattccccagtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaagcctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattggg

SEQ ID NO: 27528 - DNA, 1034 bp, Homo sapiens
acatgctgtctctctgccctggcctcttccaccccatgcccagtcagagaccgttttgaggcattgcgactgcccttggttcagttccgggaagtgtggctgcccttctgagaccctcaactgctcctcctgccaccacacagccgacgaatggaactggcttgatgcgtgctccaggaagactatggggtacctgatgaggacaagagagtctatgacctctgacactgtgctctggtggttggtcagtggtcaacactgggcccggccatatcccccatgctttccgggcctcacccatctcccactttccgcccaaatccctgcccttggccctgtcttcacagcctctggatggagatctcacccacccagctctgttttctctcccctgggcccagcccccaatctccctcttgctgtttccagggcatgaactcagggagcgagcttgggaaattgtggaggaagctgtttaaagggattcccaggctctcggtgagccattttgatttctattgtgggacttgtgtgctgttggggcgcccacagatcccgcagggctccagccttggcaacgacatcgaccaataccccgtggttttcaggaatgccagcgaccagggctcctggatgcagctggagatgctactgcggaagctctctgacctggtgtggacttcagatgctctaagtgataagattttggaagatggtctggttccctagtggagtggaagatagcaaagacacggtcaccctctttggatttggatcagaatagcaaggaaagtgtttctatcactggaaggaggataatcagaccaagggctccaaggaaatactgcccacgtctagtgcaggagcagaaatcgaagtcatccatcagctagcgtgtggacaagctcactattcacacaagctcagcctagctgagtccatacaaatcctatttctgggtgggtaaagggcaggaggaaattgtaagatcagtctggtactgaataaaatcctggcctgattgtcttacctgt

SEQ ID NO: 27529 - DNA, 1885 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttctctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacacggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggtgcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatc

SEQ ID NO: 27530 - DNA, 1088 bp, Homo sapiens
aatgtgagcaagccctggtggcagcgccagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccagggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaaaa

SEQ ID NO: 27531 - DNA, 1126 bp, Homo sapiens
aatgtgagcaagccctggtggcagcgccagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccagggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcagcccctggcctgatccttctctctgtgctgatggtccaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaaaa

SEQ ID NO: 27532 - DNA, 5628 bp, Homo sapiens
atgttctcccgaaggagccacggggatgtgaagaagtccacccagaaggtgctggacccgaagaaggacgtgctgacccgcctgaagcacctgcgggcgctgctggataatgtggatgcaaatgatcttaagcagttttttgagaccaactattctcagatatatttcatcttctatgaaaattttatagcactggaaaatagtttgaaattaaaagggaataataagtcacaaagggaggagctggactccatcctcttcctttttgaaaaaatactgcagtttctacctgaacgaattttctttcgatggcattaccagagtataggctcaactttaaagaagcttctacacactggaaattctattaagataagatgtgaaggaatcaggctgtttcttctgtggcttcaagcacttcagacaaactgtgcagaagagcaggttctgatttttgcttgcctggtgcctggtttcccagcagtcatgtcatccaggggcccttgcacactggagacactcatcaatcccagccctagtgtagctgatgtaaagatatatccagaagaaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttgacatcccccatttgagaccaaagcctgtgtacattactaccactcgagacaatgagaacatttacagtacaaagattccatatatggcagctcgtgttgtttttattaagtggattgtaaccttctttttggaaaaaaagtatctaactgcaacacaaaacactaaaaatggagttgatgtattgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacaaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggctgtgttctagatcctcagaaaggaaccaccgtggggaggtccttttctctcagctggcggagccacccagatgtgaccgaaccgatgcgatttaggagtgccaccacgtctggagcaccgggagtggaaaaggcaagaaatattgttcgccaaaaagcaactgaagtggaggagtgtcaacagtcagaaaatgcacctgcagccggatctggccatctcacagtgggacagcagcagcaggtccttcggagcagcagcacctccgacatccccgagccgctgtgctcagattcttctcagggtcaaaaggcagaaaacacacagaattcgagttcttcagagcctcagcctattcaagagaataaaggacatgtgaagagagaacatgaaggaataacaatcttagttcgaagaagcagcagccctgctgaattggatttgaaagatgatttgcagcagacacaaggaaaatgtagggaaagacagaagagtgaaagtactaacagtgacacaactctgggctgtaccaatgaggcagagctgtccatgggcccatggcagacctgtgaggaagacccagaactgaatactcccacagatgttgtggctgatgctgatgcccgtcattggttacaactgagtcccaccgatgcttcaaatttaacagatagcagcgagtgcctcacagatgactgtagtataatcgccggggggagcctcactggttggcacccagactctgctgctgtgttatggcgaagggtcttggggatcctcggagatgtgaataacatccagtcacccaagatccacgccagagttttctgctatctctatgaactctggtacaaactagcaaagatacgggataatctagcaataagcctggataaccagtcttctccatctcctccagttttgatcccaccactcagaatgtttgcatcatggctgtttaaggcggcgacactgccaaatgaatataaggaaggcaaactacaagcctacaggctgatctgtgccatgatgaccagacgccaggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctactgggagaagcttcagatgtttgaaacctctctgcctcggaaaatggcagaaatcctcgtggccacagttgcttttcttttaccaagtgcagagtactcctcagtggaaacagacaagaagtttattgtgtccttgctactctgcctcttggactggtgcatggcattgcccgtgagtgtccttctccaccccgtgtccacagcagtcctagaggagcagcattcggccagagcccccttgctggattatatctacagggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagaggagaagaagagaagaagtttggagttgatccctttgactgctcgaatggtgatggcccacctggtgaaccacctggggcactaccccctcagtgggggccctgccatactgcacagccttgtcagcgagaaccatgacaatgcccatgtggaaggctccgagctgtcctttgaggtgttcagaagtccaaacctgcagctgtttgtatttaatgatagcaccctcatctcctaccttcagacacccacagaaggaccggtagggggatcaccagtgggctctctctctgatgtgagagtaattgtgagggatatctcagggaagtactcttgggatggtaaggttttatatggacctttggaaggctgcttagcacccagtggaagaaatccttcatttctgatttcgagctggcatcgtgacacatttggacctcagaaagactcttctcaagttgaggagggggatgatgttcttgacaaattacttgaaaacattggccatacaagtcctgaatgccttttaccgtcacagctaaatctaaatgaaccttccctaaccccatgtggcatgaactatgaccaagagaaggaaatcattgaggtcattttgcgccaaaatgctcaagaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttctatgaagagcgagctctgtatctcgaagcaataattcagaaccaccgcgaagtaatgacattcgaggatttcgcagcccaagtcttttctccctctcccagctactccctcagcggaacggattaaagatct

SEQ ID NO: 27533 - DNA, 677 bp, Homo sapiens
ctttgatgtcacaatctgacctgtgggtattaatctggtcacagctgctcacagactagatggcaaggtccaggggactagcacaggaagatgtggaagagaagtgaccatcaacccaagatcaaagcagaggatggacctctggtgggccagttcgaggttctgggttcagttccagaacctgccatgccacatcctctagagctgtcagaatttgagagcttcccagtgtttcaggacattaggcttcacatcagggaagtgggagctcaattggtcaagaaagtcaatgccgtctttcagctggacatcaccaaaaatgggaagaccattttgcggtggaccattgatctgaagaatggttctggggacatgtatccgggacctgccaggctcccagcagacactgtctttacaatcccggagtctgtctttatggagctggttttgggcaaaatgaacccgcagaaggctttccttgccggaaagttcaaagtgagtggcaaggttctgcttagctggaagctggaaagggttttcaaagactgggctaaattttaagcatgcaaaaataccaaggaagaacttctcttcgatgataatgtcgagtggaaatcatgcttaatctgaagattaaagtaaaaagtatccaatatttttactcaaaaaaaaaaaaa

SEQ ID NO: 27534 - DNA, 1095 bp, Homo sapiens
caagaccctcggagccaagaaacaacactgagttccagatttcggaaggttcacgagtgttgccgacacgccctcccaactgcagacatcctccctggaggacctgctgtgctcacatgcccccctgtccagcgaggacgacacctccccgggctgtgcagccccctcccaggcacccttcaaggccttcctcagtcccccagagccacatagccaccgaggcaccgacaggaagctgtccccgctcctgagccccttgcaagactcactggtggacaagaccctgctggagcccagggagatggtccggcctaagaaggtgtgtttctcggagagcagcctgcccaccggggacaggaccaggaggagctactacctcaatgagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacagcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcgtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgcttgtcaaaaaaaaaa

SEQ ID NO: 27535 - DNA, 1562 bp, Homo sapiens
ggagcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttagggtgaaatttcaattttggcatatcactcagtgggtactgttgtgaccatggctgtgttaacactccctcccgaggagacttccctgccacaggcgctggagtcctcccatggcttcacagaagcagatggaggtagtgaccaaaggaactgggttccggcgccgccccaagaccatcacttacaccccggggacctgcgagctgttcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacggggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggtt

SEQ ID NO: 27536 - DNA, 3113 bp, Homo sapiens
aatagacaaagcaccgctggtgccctgagcgacagaactctggtagggggctggctgtaaattgacgtggcatggaaattctccgctaagttgtagcagcttgcatgtttctctaagatcaagcccagcctcctggagctgtagcttaatcatgggttcaatgactttacagaaaaatggatagaaaaattcttcaactcctttctttggacccagatggttttttttggtttttttttttttttttggtttttgcttttttttttttttttggttatctatagtttagctgaaaacaaaatcaaagcagttaagtctgtaactttctttttgcagcttaaacaacagaatttgctgctctccctcccctttcctgcaatttaattccttacagattttgccatggggtgcggacttagaaagctagaagaccctgatgatagcagccctggaaaaatattttctaccctgaagagaccgcaagtggaaacaaagacagaatttgcttacgaatatgtattgctggattttactctacaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtggacaaagacgcccaaggcttgtgattgaggaatgtcccctaacttctgaggcacaaacaaatgacgcagcaaaagaactgatagaaaagattaatgtcgctgctaaaagaggaatgaaatttgttggattcatatcacagcattattctccatctaaattctgcaatggaaccaaccatgatggagatatagaatcgatgctacatgtgagacacggttcagatgaaaactgtagaagttggaatgaagggacgttaagtgggcagtcatctgaaagcggaattgaggaagaacttcatcatgaaagtggacagtatcaaatggaacaaaatggcagccctacttcctctaaatcaagaaagggagaagcctcagataacaaattgtatacagtcttcaatgcttttgatgatgattcaacctcctgggcctatcaggaaggcatcctgtcaatgaaagtaacaagaaaaggatcagtcattagtacacttgatgctgattggctggagttaactaccttttattataaacaaggcttgtctttaattgattcttttgtattctgggaaacatctaaaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagataagaaagccagccaccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtgagccatgaggtgaagcaaaggaaggccctgtaaataattgttaaaatcattgccaactgaccttattgtattactttctctgcatttatgtaatatttttgaatttttccagacccagcctttcctctaatctatgtaaactttggcacaacctcccagacaaggaagaataaccaacatatttatacatttagaatcatgtttacacttctctcaactaaaacatctggttaaacagatgttccattcggttattacacaataatctatttcagcttctcatgaatgtacaaagtagactttcttacaattcctggtaaggagactgaatatctcaatcagtattttacccaattagagagagttctcaggaagttacagtcttatttaagctgaaaaataacctctctctctcttttttttctctctctctctcatacacacacacagctaattagtgcaaataaatatctatttcccaaatataataattaatccacattttgtctttaactatagcatgtatatacaaagcaagcccctatgtgttaaaatattttttgaaaaaaatcttttttatgtatctttgcttttaaagggtcatgtcaccaaccctgtactgattcattgcacataaatgttgttgctcctaaaagcctaaaaatgcagacagcaaagcagcatctcttaaaattcaatatgaaaagaacccataatctcaatacataaataccttagtagagagtaagatttaatttttttttattttaaagtccaaatactatgaagaggaaaaatatcaacttcaatttgaaactgaagtcttttacatctgtctagatttgaattctgcttttattttgacttgttaaatcctgaagaatgttgaaacctagaattttcaatctggcaggagtagaaagatgctcatagcacacgcaatatgtatgataacatattttgtttcatcttgcttttctttccccttctaatagaggtggctttgccttgacccagcctttaacaatctttaaaattctacaaaataaaggattttcatttatctatgaaaggcttactttgaaagatggaacctccaagtgaattacaacttattctatcattgatgaattcagcctattatatatttttattaacattgatgttgacattgtaagatcattttaataataaaacatcattttt

SEQ ID NO: 27537 - DNA, 971 bp, Homo sapiens
cctggggctgctgttcctgtggtaatgtggcagctgggaccatggccagcttcagtctgcctggcgtcacataagccagcccacagggtcctgcagcttgtcctttctggctggaagctctgggcatagcctgggactgggtctttccagagagggctgcagccagggccctgccagcctcgggggccacagcggctctcacaccagcatcttgctggataggagcagttccaggactctctgatcacacctgatcatcgtcactgccagaattcaaggtagctgcctgccatggctgagaggtgtgcctcagcttaacccactcagtgatggactccagtgcctgcaagaagtctcaccagagtaagaagtggaggatccaggcccaggagaattttgccaagaagtttccgtacaggttgtcgtggctgacagagcccgaccctgagcccctgcagccctgggaggtcacaaacgactcgaacacggtgcagctgcccctgcagaagaggttggtgccaacgaggtccatcccagtccgagggctcggggctccagattttacatcaccgtctggctcctgcccggcaccactaccagcaccatcaccacctccactgtgcaacctttgggaactcaagttgctgagtcgccgcttccccagacaactcgccttcctgctgtccacccggcacactgaggctgcctgcccccagaccagcaaggcggcagggctgtccaggggcctctcctagagactgggctctgtgtgtggccttcttattggccaccttctccttggcaggctctgggcagtagccacagagactttagtaaagggatcagccttcatggccatcatagaccgggagtggtttgtggtccccccaaaaagctacaccaagctaataaactgcgagttcccaccccacttccagctggaatgaaaaaaaaaaaaaaaaaaaaaaaaa

SEQ ID NO: 27538 - DNA, 1105 bp, Homo sapiens
cccggatggtgggactgggcccaggttcccaccgcatcgtccgcctcagccagaaccttctggtccccgcccccggatagggacccaggaggcccaagccccttcttccggcggggagtgggagcctctcgcactctcggcagctccagaccctcgggatctccgtttacagttcaggacctcagctgcactttggcgctaacgccctgtttcccaggactgtcaatggcaggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggagtgagtcccaagttaccctgccacacatcagagttgcgcacgatgaacaacaaaggactggtcaggaagccccagcccatccgcctcagtggagtagattctgtctttggcagggttatcacagctcagccaccaaagtggaccgggactttcagagtttcagacaagtcagccttttgcaaaatcattagcagggagcaccagtggcccattggactgaaggagcctcagattcagatgacagtcactatgtgcaaacagatgctgcgctctatcctcttgctgtatgcaacttacaaaaagtgcacctttgccttgcagcactccaagtaaagggtcctcatttgatccccatttactcacaccatgccctttgtgccttggtgactgtcaaataaaagcaagtatatactcagttctctccacacttcccacatacttaccaagcaaaaagcccatgaaaaatctgcagcagcctctgatagcaggaagacattatgtggtactcctgaactttcactcctggtccatcaactacaccgtgattctcagcagctaaacactaaaaataaaaatgattttaggacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27539 - DNA, 1814 bp, Homo sapiens
agtgcctggcaacctagaccagtcagggacgcggcaggaaatggaagagcctccgcaagaggctctggctgaacccttgaaacatgaaagcccagccgctccctcaagtgctggccacactaagggccaggaagaagacgaccagaagaaccaggccgaaaggaaggcagataaccacactgctcacagaatagctgaccagactgccctaagagtgcctagccaggctgaatccagcatatttagccaagctaccaacggagtagctgaacaaaatgggcatagtacacctggtcaggctggccgcagagcatccaaccctgctgatgtttctgaccttagagcagatgatcaggttaatcaaacaccgtctgaacagactaaaggcaaggcatctagccaagctaataatgtacagcatgaacagagtgatggtcaggtgtctggcctgacggaggaaagaactgctgaacagactgaacgaagattacctacccaggctgagagaagaacttctgggcagattgatggtagactggctatgccatctgaccagagaggttccagacagaccgaccacagaatggcaggccagtctgagagaagagcttccgagcagatggaccgcagaatgtctggcgaggctgagcgaagaacttctgagcagattacacacagattatccaaactatctgagagaagaccttctgtgcagattgacagtgggtcatccgtcccatctgaccaaagtccttctgtacagattgacagtggatcgtccgtaccatctgaccaaagaccttccgtacagattgaccgcagaatgtcagggaaagttaggagaagaagttctgagaagactgactacagattggctggcctggctgacccaggaacttctgagcagactgacctcagattgtatggcctcgttgaccacaaaacatctgtaaagactcaccaccaagtgtacggccaagccactgaactagctgaacaccaggctattgaccaagctcatagtaatgctgatcaacctccagttgacaatgctcactacactgaatctgaccagactgaccacttagcagacagacaagctaatcataaagaccagctgtcttactatgaaacacgtggccagtctgaagacagaatatttccccagttaggcaacagcaaagaggacaaagaggctgactacagagtacaaccctgcaaatttgaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatcttatccaaattgaactataccagcagtcaagaaaaaactcaagccatagtaaccaaatctgatgaattttcagaaattgaccaaggaaagggttatcatatacgcaatcaaacttatagaaggttcccttctatagtttatgaagatccttaccaagtttcactccaatacatggaaaaacaccacattctgcaaatattccagcagattactgaaaacttagtctatgaaaagccagaggaccccctgaattttatgctgtgccaggtatagaattggagaaaaagaacaacctttttattctctttattgtaaaatacagcacacatacagcaaagtgtatagaacaaagtacgtacaactctgaattcttatgaagtaaacatacctgtaactaccattcaagtttttaaaaaataaataaaacataaccagc

SEQ ID NO: 27540 - DNA, 2067 bp, Homo sapiens
gagagccgaccggggccgcggccaaagagctggctgtaatcccgcctcccgccagccatggcccacttgcgctcgcctagcggcttcggagacccggggaagaaggaccagaaggagtcagaggaggagttagaggaggaggaggaggaggaagaggtggaggaggaggaggaagaggtggaggaggaggaggaagaggtggaggaggaggaggaggaggtggtggaggaggagttggtgggggaagagcaggagttggaggcccctgagacgttcagcgaagagtacctctggaaggtcacggacatcggtgactacgacgatgacttcccagacgtgcgcccccgcttagccagcatcgtcagccctagcctgacctctacgttcgtgcccagccagagcgcgaccagcactgaaacgccgagcgcaagcccaccctccagcacctcctcgcataaaagtttccctaaaatatttcagacatttaggaaagacatgtctgaaatgagtatagatagaaatattcatcgcaatttgtctccaggaattccagtatcagtacaaacagaagaaagttggctccaagatttgtctgataaagtgcaatcgaggaagaaagcctctaaagagaaagctgaacctgaatgtctggcatctaagttaagagaaaaatgggtaattaatccagaagagtcgaaactaaatattttatatgagctggagtttaaggaagacttcataacactgttcgagccttctctaagaacgttacccagcatcggaccaccatccattctggcatacaaagaagagagctccaatttaggcattaacttcaaggatgaagaggaggagacatcacccaaatgtgaattttgtggcagcgatctaagagcatttttttctaatgtggatgtttcctctgaaccaaaagggcatgcctcctgttgtattgctttccaaaatctgattgactatatctatgaggagcaaataaaaaccaaaccccctaaagctgaattaattgctattgaccctcatgcagcccatggtagtgaggtcgacagactcaaggcaaaagaaaaagccctgcaaaggaaacaggagcaacgaatggccagacattttgcaataatatcaagggaacagactcatttctctgaagatgattcaaagcgcttaaaaacaatttcttatcaactttctgtggatattccagaaaaacagataattgatgacattgtatttgattttcaactaagaaacagtaacatgtctatcatttgttgtgattctcggatagcatgtggaaaggttgtcaggaatgagctcttagagaagcactacaaacatgggagcaagtttctgacttcatttccagatgggacaacacaaatattctatccatctggaaacctagccatcattcgagtgcccaacaaggtaaatggttttacttgtatagtccaagaagatatgcccactaaccctgctatcctagcagtgctggattcctctggcagaagttcctgctatcatcccaatggaaatgtctgggtatacatcaatatcttgggaggtcaatattcagatcaagccggcaacagaataagggcttggaattggtcaaattccatcacttcctcaccctttgtttcatttaaacctgtctttctggctttgaaccgttatattggagtccgcatcttagaacaagacaagatttctataacttttctagcaatgggccaacaggcaagaatcagtgttggaaccaaagtgaagctaccaaaccctgaggagattccaatcctccgatacgtaagtggagatgaccttcttctgctggccagtttaataaagatccgtcgcctgtttcataaacttgaaggatgtgtgaattttccctcaagccaggtttgggaaaaattaaagcaaccttcctacctttcttcactttctctaaaactaattgccctttgtcacagttctggtataaagcaagatataatgaagacaataagaaatataataaatgaagaaatttaactaaaaaaaaaaaaaaaa

SEQ ID NO: 27541 - DNA, 1611 bp, Homo sapiens
ggctctaccatcaagtgaggggaatgcccaccatcgctatcatcaccatcaccactacttctgccacagccatcacattcacctctacctccaccatcaccatcactactcaagttggagaaatagaggccaggggaaggggataaagggagggcaaagaaaagtaattccaaaggaacatgagcaccaataatgctttaagagtgttttggaaatcaagagaatggaatatgaaaacatcaacatttgattcagatgaggatattctacttttacccaaaagaaaacgttttagaaagaaaaagtcaagaccagtgagacacaccaaacgccatgaagaggagcaggtctatgagcaagggaccacattaccctgttccatatgcaagcacgaaattgacctaactggtatttttctccataagaagcaacatgtagctctggccacgctgggtttccaatggatgggtagaaagaaaccacagccctcagtgattgctgttcagagacagttcatgatttctaaactattgtcatcttttatgttcactgaaaaaaccctacagagcattaataatgcttttgagctgctttggaaaaaacaaataccagcatactataagatttttgataacattgacaggagtgtcatatattctcaaaaaatatgtcatctgttaattaaaggagtgggcatttgtgaagacaggaattctacatggaaagctgacatgaatgataaattcactgtagtgagtaattttggtaacaaacctaatgtgtgtttttttggtttgtttgatggacatcacggtgcctcagcggcagagttgacatcaatggaactcccagttttacttctccatcagctttccaaatttgatccttcttaccaaatgacaactgatgagcaacaaataatcaattccttttacactgtgtttagagaagaatacacagcaatagaagacctcttttctgccataaacaaaacagaagcagtgaggtgtgagtatgaggacacacacaaagcctttgcaaaagcattttggagaatggataggcttttaggtcttggaagaaaagaagtgtccagggttcaatggagtggctgctctgcagttacttgtatattggaaggcaaacctaaaagtccttatgctcataagaattggaaaagaaaaaatacccatgatgggttggcagagagctccccttccaggagatgccaaaaataatttctggaatattacatgttgcaaacactggtaccaggagaaatgaacatttgcctgaatactatggctaagcatcataaataactttagaatctccttctaaacaaagaatgtttttgaaaagcccaaattaatgtgattctgggtgtcatctgtcacatttgtaaaatgagtatattatcacacaatccttcgcaactgtgccagcacttccctagcaaactgcaaacttgagtttttcaggaaaacagtttacatgagaaaaggcaagttctttcccatttcgaatgaagtaccattaaactctgtcacctagtgaaaaataataaaaatacttgcaacttttaaaaaaaaaagaaaaaaaaaaaaaaaa

SEQ ID NO: 27542 - DNA, 1613 bp, Homo sapiens
gccacacaggctccttggagtaagagtgtgagaaactggatgaagacagctgtattcttttggaagcgttcgagattggtctgtctctaccaactaaaaacttctagcttaagtgcagagatttaaggagatcaacaaaaactcagtctagacatattatgaggctgggagggtatcaacagacttgagttcttgtcagcaagatcacctgcttttaatattgtcctcagggtctgagcacatctggaagtgaggtcaatcaagttagaccccaaaaacttttgtgacaacagtgaagaggggaaaataaacacaccacaaacatgaacctcaaccccccgacatctgctcttcagatcgagggcaaaggcagccatattatggctagaaatgtaagctgctttctagtcaggcacacccctcatcccagaagagtctgccacatcaaaggcttgaataacattccaatctgtactgtgaatgatgatgagaatgcatttggaacattgtgggaagttggccagtctaactacttagagaagaacaggataccatttgccaattgcagttaccccccgagcactgcagtccagaagagccctgtaagaggaatgtcgccagccccaaacggtgccaaagtgcctccacggcctcattctgagcccagtagaaaaattaaagagtgcttcaaaacttccagtgagaatcccttagtaattaaaaaggaagaaattaaggccaaaagaccaccatcacctccaaaggcatgctctactcctggctcctgttcttcagggatgacaagtaccaagaatgatgtgaaagcaaacaccatttgcataccaaactatctggatcaggaaataaaaatcctggcaaagctctgtagcattttgcatactgattctctggcagaagttttacagtggctgcttcatgcaacttcaaaagaaaaagagtgggtctcagctttgattcattctgagcttgccgagataaacctgttaactcatcacagaagaaacacctcaatggaaccagcagcagagactgggaagccacccacagttaaatcaccacccacagttaaattgcccccaaattttactgcaaaatcaaaagtgctgaccagagatacagaaggggatcaaccaaccagagtgtcaagtcaaggatctgaagaaaacaaggaagtaccaaaagaggctgagcacaagcctccactacttataagaagaaataatatgaaaatacctgttgcagaatatttcagcaaaccaaattctcctcccaggcctaacactcaggagagtggatcagcaaaaccagtgtcagcaaggagtatacaagaatacaacctctgtccccaaagagcatgttatccttcaacacaccggaggtagaagttctagactgggtgaattctttcatgaatatgagcttcacatttacatcatcaaattatttttcaaatgaatatttttggtattgaggaatcaagtggtcctctttatggtggcacatgtaaatctaaaaatacctgtatgtaatgctacaaataaatattactggaaatgatatttccatttgtagttaaaaaaaaaaaaaaaaaa

SEQ ID NO: 27543 - DNA, 5470 bp, Homo sapiens
ccgcctctgtcgccactctctccccctgttccgcgtctgcgtcgccaccaccgccgggggtatccggggggtcgcttaccgggctggccccgcgccacagccgtagctttaacctccccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacattgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtctgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacatgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttttataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaaaaaa

SEQ ID NO: 27544 - DNA, 2222 bp, Homo sapiens
ctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgtttcataagttaagacgtatatgattccgtcaagaaagactggatactttctgaagtaaaacattttaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27545 - DNA, 3556 bp, Homo sapiens
cttaggaaggaaggttggcggcggtgaagagggaagaggatgatctagtaatgggctcttccaaatcgcatctggtaggttcatagccatgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggcactaaactcaattctgttcggcagcagcagctgcagcagcagcaacagcagggtaacaagaccgggagccgcacggggccgcccgccagcatccgaggaggcggaggtggggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatctcaagaaggagcgggcggcagcggcggcggccgcggctcagatgcacgctaagaacggcggcggcagcagtagccgcagctccccggtgtctggcccccctgccgtttgcgagaccctggccgtcgcctccgcctccccaatggcggcggcggcggagggcccccagcagagcgcagagggcagcgcgagcggcgggggcatgcaggcggcagcgcccccttcgtcgcagccgcacccgcagcagctccaagagcaggaagaaatgcaagaggagatggagaagctgcgagaggaaaacgagactctcaagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagagttatccttaaaaagaagaggaagcaaagatttgccaaaatctgaaaaaaaggctcaacagactcccacagaggaggacaatgaagatctgaagtgccagctgcagtttgttaaggaagaagccgctttgatgagaaagaaaatggccaagattgataaagaaaaggacagatttgaacacgagctccagaagtacagatccttttatggggatctggacagtcctttgcccaaaggagaagccggaggccctcccagcactagggaggccgagctcaagctacggctaaggctggtggaggaagaagccaacatcctgggcaggaaaatcgtcgaactggaggtggagaacagaggcctgaaggcggaactggacgaccttaggggcgatgacttcaacggctcggccaacccgctcatgagggagcagagcgaatccctgtcggagctgcggcagcacctgcagctggtggaagacgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtctg

SEQ ID NO: 27546 - DNA, 2418 bp, Homo sapiens
ggggcgcggggtcgccgccggccgcccaggcgcggagcctctcgggggtcacccggccgccgggcccgcgggacgcacggggccgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacagaataacatgaaagctgtatacctattgtggaatttgattagaatccggaacagtcagagttggaacaatgttcacaacaaaatgcaagttaataatgaaggaaaaataaaatcagtcaaatcagcctaatgctttgggaaaaatctaaattcagttaattctaccacaaacaacatgtaacctgcttatgactggcaacgctgaaggaggattcaaaggctctcatctcgcgctgcttgcctgacctcttgctttctaggagctgacttaccctgtcagatgcatacacggcatcgaatagcccaaggagggtgacggagatgcccacagctggaccattgaccactgcaatcagaggcttaggaaaatctataaaacagcccacaaattccctacagaaatggaaacacaaaatcattaaatgtgccaaagcagcatgactaaagcatgggcaagacagtctgactctgagataaagccttctgtcaggctgggtgtttccacagccaccaccagcagtgcctccttgtcctgccacttccctggtcttccgcaccagattcatccagggcatccgtctgaatggcagtggatggaagaccaaccagtgagacctatgggtcaaccctggtttgaatcttgtattctggacggtgagttcagggctgtaaaccagccgcagtcttagagattaggttgggtgactgagcacatgctgcaatatcacaacaagtgggaattacagatttggcaggaataaagagaaaagccttcatgacctcctcctgtgtttacaagactcctccgagtctcctaccttcagcgttcatggaaatctcccattcctctggctggatgagaatttgctaaattcctctgcctcagtgcaagataattttgtttacaactatagctcacttttatgttttccagtcaaatctcatgagaccagcaggatgaacaggtaacagaggtcaaagagaaagaatgaatgcccacctatggatggaggcagtttagagaaatatgcttgtccaaagtcacaattaactgcactgacacagagaagcagatattgcacttttgctcaactaaataccactttgatgactaagaacgggccctctgggatcagacaaaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacaccaaatccacatagttctgcctggcagcttcctgaacggacgatgacaaacaacctcagcccatggtcaatgaataagcactttgagaaagttactatactaataactaacaccttgcaatgaagaaagaatagaagcacatcaagatcttgaagactccatttacaatggcttaatgagaagcacaaacttctttagaagtacagcaaataaaagcacagtaactagtaaacccaaaaaaaaaaaaaaaa

SEQ ID NO: 27547 - DNA, 2510 bp, Homo sapiens
ctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaactcgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 27548 - DNA, 1184 bp, Homo sapiens
acctgggcccagggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgcccgtgagtgtccgggccctggggagagggctctgccccaggaggcacctgctcccgaggcctctgctgtgggagggcccaaaggcctggcagtcgagcgagagcggcacgggcgggactcaggtgagctccggaggctcctcaactctttggagtgcaaacaggatgagtacgccaagagcatgatcctgcacagtatcactcgctgtgtgtacttgctggaggctgaggcctctgcttgtactacggatgacatcgtgttgctgggctacatgctggatgacaaggacaacagtgtcaaaacccaagctctgaatacacttaaagctttctctggcatcagaaaattcaggctcaaaatccaggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctagcacaggtgcaagccgtacgactgctgagctacctggcacagaagaatgaccttctctatgacattctcaactgccaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgagtataggagagaaacaaaaaaaaaaaaaaa

SEQ ID NO: 27549 - DNA, 972 bp, Homo sapiens
ccgtgaggtgcccagaagatcatgcagtcatcagtcccacggagcagcccgcgaggctgaggctcctcccactggaccgccccccaactggcaccactgctgcccctgcccctactctcagcctcacgtgactctcgggcagaggcagtggtggggcagccagggcagcgtcaagagtctgagccagctgcaggacaaattcgagcatcttaaaatgattcaacaggaggagataaggaagcttgaggaagagaaaaaacaactggaaggagaaatcatagatttttataaaatgaaagctgcctctgaagcactgcagactcagctgagcactgatacaaagaaagacaaacatcctgatccatatgaattcctcttattaagaaaaataaagcatccaggattcaatgaagaactgactatcaccttgttaatcattcagaaacatgttgcacgcttaagccatttttgatatagatactgaaacaattacttgctaagagcaatcttgaaggtatggataaggccctgagtcatcttcctgagctgaatgatagttaagctgaattaacaatttggacaagacagcaaatgctattgtccaagttttctaaagaagaatctgaaatgaaatgacatcaagagacctatcaagacctgtatccaggaaaaggtttatatgtggaagagacttgccctgtctcaggaattagagaaagaacaaatcagtgtgaaggagaattgtcagtaaaattacaagaaaagattgagatcataattgacctttgaggataataaaatttaaagaccaaaaggatggacttcacagaaacatgaccttaggttgtttttgcagttgtagtaactggttatatgaccaacaaaatatgaagaatgggtacaaattctgatagtaatgatcagtcactttgcaaatataaagttactatttactactgtattgtacaggtt

SEQ ID NO: 27550 - DNA, 930 bp, Homo sapiens
gctgactgcagcctcaaccttccaggctgaagcgatcctcccatctcaatctcctacgtggctgagactacaggtgcttgccactatgcccaactaacatttggaattttcgtatacgtggattctagaggggtgacagcgaaacctgcaggacaaattcgagcatcttaaaatgattcaacaggaggagataaggaagcttgaggaagagaaaaaacaactggaaggagaaatcatagatttttataaaatgaaagctgcctctgaagcactgcagactcagctgagcactgatacaaagaaagacaaacatcctgatccatatgaattcctcttattaagaaaaataaagcatccaggattcaatgaagaactgactatcaccttgttaatcattcagaaacatgttgcacgcttaagccatttttgatatagatactgaaacaattacttgctaagagcaatcttgaaggtatggataaggccctgagtcatcttcctgagctgaatgatagttaagctgaattaacaatttggacaagacagcaaatgctattgtccaagttttctaaagaagaatctgaaatgaaatgacatcaagagacctatcaagacctgtatccaggaaaaggtttatatgtggaagagacttgccctgtctcaggaattagagaaagaacaaatcagtgtgaaggagaattgtcagtaaaattacaagaaaagattgagatcataattgacctttgaggataataaaatttaaagaccaaaaggatggacttcacagaaacatgaccttaggttgtttttgcagttgtagtaactggttatatgaccaacaaaatatgaagaatgggtacaaattctgatagtaatgatcagtcactttgcaaatataaagttactatttactactgtattgtacaggtt

SEQ ID NO: 27551 - DNA, 1170 bp, Homo sapiens
actggggagtttgtcttttcaacatcagttaatgcttggaaccattcatacttgattaaaatacatcgttgaaaactttccctgtttttgatgagttgatttttgttttaactgatttaaactttttcaaggtttaggcaatgacatcatcacaattgttgattatttggtaaactatgacttcttgcaacagattagtggtcctggtttatgttcttgactagtatgatgttatctggactgggctgtaaaaatctgtgaacactgttgctctgagttaggaacagaatggctggggcagaaccatttttggcagatggcaatcaggaattgtttccctgtgaagtctgtggaagacgttttgcagcagatgttctggaaaggcatggaccaatatgtaagaaactcttcaacagaaagcgtaaacctttcagttctttgaagcaaagattacagggcactgacattcctactgtgaagaagactccacaatccaagtctccacctgtgaggaagtctaactggagacaacaacatgaagactttattaatgcaatccgatcagcaaagcagtgtatgctagccattaaagaaggccgacccctcccacctccaccccctccatccttgaacccagattatattcaacgtccatattgtatgagaaggtttaatgaaagcgcagctgagcgacatactaatttctgcaaggatcagtcttctcgccgagtctttaatccagctcagacagcagccaaattggcatccagagctcagggtagggctcagatgggtccaaaaaaagaaccaactgttaccagtgctgtgggagctttgctgcagaacagggtcctggtggccacgaatgaagtcccaaccaagtcaggattagctatggaccctgcttctggagcaaaactcagacaaggatttagtaaatcttctaaaaaagattaactcctagaagccagactgcctccctgaaacccatcagcctggatggttgcgtacccgagaatgccacctaaggggaaggaacggtagatgtgatgtctgtttttacacccttgattcttcttgaagcatcacttagaacaagtaaaacttgcttcagatttttatttactccctttgaagttttcaaaacaaaagcattaaacacatcaacct

SEQ ID NO: 27552 - DNA, 1170 bp, Homo sapiens
actggggagtttgtcttttcaacattagttaatgcttggaaccattcatacttgattaaaatacatcgttgaaaactttccctgtttttgatgagttgatttttgttttaactgatttaaactttttcaaggtttaggcaatgacatcatcacaattgttgattatttggtaaactatgacttcttgcaacagattagtggtcctggtttatgttcttgactagtatgatgttatctggactgggctgtaaaaatctgtgaacactgttgctctgagttaggaacagaatggctggggcagaaccatttttggcagatggcaatcaggaattgtttccctgtgaagtctgtggaagacgttttgcagcagatgttctggaaaggcatggaccaatatgtaagaaactcttcaacagaaagcgtaaacctttcagttctttgaagcaaagattacagggcactgacattcctactgtgaagaagactccacaatccaagtctccacctgtgaggaagtctaactggagacaacaacatgaagactttattaatgcaatccgatcagcaaagcagtgtatgctagccattaaagaaggccgacccctcccacctccaccccctccatccttgaacccagattatattcaacgtccatattgtatgagaaggtttaatgaaagcgcagctgagcgacatactaatttctgcaaggatcagtcttctcgccgagtctttaatccagctcagacagcagccaaattggcatccagagctcagggtagggctcagatgggtccaaaaaaagaaccaactgttaccagtgctgtgggagctttgctgcagaacagggtcctggtggccacgaatgaagtcccaaccaagtcaggattagctatggaccctgcttctggagcaaaactcagacaaggatttagtaaatcttctaaaaaagattaactcctagaagccagactgcctccctgaaacccatcagcctggatggttgcgtacccgagaatgccacctaaggggaaggaacggtagatgtgatgtctgtttttacacccttgattcttcttgaagcatcacttagaacaagtaaaacttgcttcagatttttatttactccctttgaagttttcaaaacaaaagcattaaacacatcaacct

SEQ ID NO: 27553 - DNA, 3609 bp, Homo sapiens
tcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggtatgtccagacccccgaggcaccgcttgcagggcagtgacagcccgtgaggctcggcctcgacccctggcacccttggtcccagctacgccggctcctggccttcccccaagtccgagagagaggtgggattctccccgacgcagttggaaaccgggaatcccctttagggtcccgttcgtgctgcactactgactccaccatctgcaaagggattcttgtccagaatccccgaaggctttaggacagcgcttattttgttgaatgaagagtctctaattttcggaaagaccacaggctaaaagtcaagttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacatctgtcgcggcgccatgttccccaccttcacgtcacctgaggacctctacacgggcattaaagcccgcacccagcagccctttcctcccacggtgccaaccaaggcttatgattcaacagttttgaagacaagaggtaatccttatagatatgaactgattgatattcccatggattcaaagaagaaagcactgacttggccaggtcaaggtgtatattatgattttcccagaggtgttgagaaaaataagccagtattctacccaaaacctcctaaaaccttcgctcctaacacttctttaaattcatgggaccctatttgctctgccaaagaagccaacatacaaagaaatcttgagaggtcccactggctcacttcgtacactcatgattttacaggtctggggcccatggacccccttgaactggatgattaccatgaaaagatggtagcagagttaacacgaaagataggatttgacccagagccgcaagaaaaattccaccctgtcttcaaacctcccagaccgttggaaggacgaattgcccgattaattcagaaccgacgttctctggaggctatagtccagcaaagaccacgttcctgtccagattgtactcctagagttttgtgtaattttcatacctttgtacccagttctaaagaaatggtggcacttagtgataacataccagccggtgtgacccataaaaaccaggatattgaagagaagatcatagaagaacagagcttgctgtctacctatgaactcccatcttgttacccaacaaaagacctaactagcatttatgacataaagccatttccaaaaatcacagatactaaaaagacagaagatttatactggagacagcagtcactaaaaacccaacccacaccttactgtaaaccagaccactggattcactatgaaaatcttaaatctcccctacgtgatcagtataatatgtgtccagaccctgttagccttagtaaacctagtgttttacaaaataaacaagacacggaagctttcactttagaacattttttaagtaagccagaagaagagttgttcttgaatatggaaaacaatgaagaaacaagacctgttcttggttggattcctagagctggagtgaccaaacctcagaccaacctgctggagcttaagaactctttttcaaaaactggtgcacaaaagcgtttccataaatcaattctagaagaccataaagacctcagggataatgagcattcggggatgaagcaccaattctatggccataattcctattatttctataattgagatactcattcttcccttcaaaacccagcctcttgcaagaagctaaaaaatataacagaatttccttcgtattgctggattctgttttctagattaaaccacaaggaccttgttagtgaggtttacattttcaggaatttaagttagtatctggttggaggaacccagaaaaggtgatgttatgacttcttgaaaagtttaacaatttggcaataaaatattagaactagaaaaatttatagtctttaatctctcatcttcagattatacaaggaaattttccaaaatcacaaaaagcaatgtgtacaacaaagtttacatcattgtttcaccaaaaaaaattgaaaagctggaaagaactcaaatgatcaataattaatgaatgactatacaaattatagtatcttaataaaaatgagaacactgtccctttatgtaaatttttgtacatagtagcattaggtagaaaagacaaaacccaaacacctagttaattgagggatggacacctctaaaaactatattgtcttaaaagtatgtggactctgttcctttatgtaaacatgtaaagaaaataagtcagcgaaaaaaatgaaacccaaaactctctgcatgtacacattacaaattgaattgtttgcttacccttaaccttctgattgagaaacataactgtttcttttatgcagataaaattattttactgaagatctagcaatggccttaattagcaactggtgagttctaattatagcaagaaaggatggcttggtatcagttattacagagccccaaatcttcatttctggagtgtgttctctaagagtttggctaactcccatatgcaagtcaattcatttaatgtgccaagaggtagattttaaacatagtctatcgtggaagttcaagaggaatttctttaagtattttgtgaatatttattttaattttatgaccaacatgtcatttggttgtaacctccttaaaactattctgggctaaagttagagaatttttttccaactgcattctgtacagcactagttacattatgacaggaagtaaaagtttacatggtgaaataatactggggaaatcggagcaacaatgtcagttgcatgccttggtcactgggttctctatagcctttaatatgtaatgcaattgggagtgtctgaagtgagggagatatagtgtacacactttttatcacagagtagatcactggaatggaattccaaataataaactttggaaggtgtaactctccagtat

SEQ ID NO: 27554 - DNA, 791 bp, Homo sapiens
agcgtggagaaaatgcccctggaaagggttaagggccaggacaggaatggggcaggaggtgcacggatcctgctgggcactgggagcagggggcggccaaaggcagtgggtgggcaggtccatgcctcccctggccccccagctctgcagggcagtgttcctggttcctatcttgctgctgctgcaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggctctctgcctctgatcaccatcactgtatctcaaggttcagcagcagagataccagttgccatcagtgctaactgactgcctctccaggttcggagtttcatctcccagggccagagacagcagacccacatccttctctcccacacctctcctggttttgttcaggacagcagattagaggcaggaggcaatgacaataaaataacgataaaatcctgagaaaaaaaagaaaaaaaaaaaaaaaa

SEQ ID NO: 27555 - DNA, 1901 bp, Homo sapiens
atagggcagggctaggggctcggtgggggctcaggatgggggcgtttccgggtgaggaagcagctaggggcgggtaggtgggggtcaaggtggggggaccaggtgacggggtagcctggggtgaggacgtcgttcagtagaacagtgaagggcgagggtctcgccggggcggtggcggggaccacactgggaggagggggccggggttgacctttctgtgggggatgggattcggagccccgtcgaatttgggggtgggtctggtcctggggaaggtttgggggcgggtctggtcttcggaagggtttggggcgggcctggtcctgaggagggcttggagcgggcctggttctggggatggtttgggggcgggccgggtcctggggcagggtttggggcgggtttggtggggagggggcgggcctagttctgggggtgccccgcccccgccttagccccgcccggcccactgggcccgcgtcccgcaggagccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggcgcaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaagcttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttaaaaaaaaaaaaaaa

SEQ ID NO: 27556 - DNA, 1863 bp, Homo sapiens
cactaagcgaccctcagctgtgtgggaccagccctgccaacttccatcgtgggctcagctgcagctgccacctgcacacggtgcggggaagcagtgatggcaacctttcaccgtgcccacgccaccagcagcgtgaaacccagggccagacgtcaccaggagcctaattcaggcgattggcctggcagctacagggcgggaactcgctgctcagccatcggatttaggctgctgcacagtccccagcactggcgacctcgttctctgggcgcagggcaaggaagagaggaccccagttgggagggtggtgcactcggagacctgaaggccctctgggaccagccttgccagcctccgccttgggttcagctgcagctgtcatctgcatatggcgcgcggcagcagaggtggcaactctcaacgctgcccgagccaccagcagcgcggacccctggccagatgccccagcagcgcctaattcgggcggccggcccttcagctgcaggaggggggaaccagtggctcagccccatgtaggcggctgcacagtgcccagcactcaagacctcgcgctcaaaagagggcacaggaggagcagctgcagggggcagcgtcgttaggcgggccctgagacagctgggaccgcgcgctcggctctagggagctcggccagtccacaggcgtctcagcagcagctgccacctgcatgcggtgccggcgagtgctcggctcagggcggtttctggccacacgcagtttctggccacgcgcaaggcggttgccttttgaggtcccatgggcgctggggcccaactgctctgctccgtatattatttattctccgagaggttggagacgtccttgtccgagaagttggagggtccctgtctgaggtctgggccagactgccttgctttctggtgctgggccggatgggggccgggtgggggctgggctgggggaagggcgagggcgagttgtggcgtctctgaagccaatagctgggccatgaagatgatcttggctgtggagagccagaagggccaggtgcgcctgagctcctggagtagtaactgcatcttctctgacccctggtaccagactccagatgaggatgtcgggatgatacacaaagctgcgtccaggggaacgcgtgggagctgcagctgaggctcccgctgaagagaaaagaccagtctgaaatctacaagaacagagaattcttccaaatcaacatgaaaatacctctaaaactgggcaaagtactttttccagctctgcaagtcacctatgcacataggaaaaaaatacttaatgtgtccgataagagaaggactttaatttaaaaaaggaataaaatgccgttttctgtcctaagtttgtgaagatgaggagcagtgatatttacacttctgcttaaagttaagttgctgatgacttttcaaaaagacaatttggtggatggttccacatttggcctgtgccaatggctgcccagaagtggtaacttttctggtgcacagaaaatgccagcttaacatctgtgacagtgaaaacaagacacctctaacgaaggctataatgtgccaagaagatgtgaaactattctgctagaccttggtgctgatccaaatattaccgatgtctatggcaacactgctctccatatgctgtctataatgagaatatgtcaatggtagcaagactgttttcacacaagacaaacatcgaagtgaaaaacaatgtagagcaaccaatgttattttcaaaatatttgaaatccacttgttttaacattgacatatgtaagggtcagtttttgctatttggaagcttaagcaatccctgaataaaaataatttg

SEQ ID NO: 27557 - DNA, 1863 bp, Homo sapiens; identical to SEQ ID NO: 27556

SEQ ID NO: 27558 - DNA, 409 bp, Homo sapiens
gtgcagagactcaagacagatatgaccacgtgaagagacaactgtaaaacaagtggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcagtgtcaataaaatgaacaagcctggaaaacatagaaagaccccatctccaaaaataaataaataaataaataaataaataaaaatta

SEQ ID NO: 27559 - DNA, 1987 bp, Homo sapiens
gggggcggggctgcctgcggaaggggccgtgcgcgtggggtcgctccgcagctgcgagttcatggcgtcccggtgctccgagccctacccggaggtctccagaatccccaccgtcaggggatgcaacggctccctgtctggtgccctctcctgctgcgaggactcggcccagggctcgggcccgcccaaggcccctacggtggccgagggtcccagctcctgccttcggcggaacgtgatcagcgagagggagcgcaggaagcggatgtcgttgagctgtgagcgtctgcgggccctgctgccccagttcgatggccggcgggaggacatggcctcggtcctggagatgtctgtgcagttcctgcggcttgccagcgccctggggcccagtcaggagcagcacgctattcttgcttcctccaaggaaatgtggcactcgttgcaggaggatgttttacagttgacgttgtcgagtcagattcaagcaggtgtgccagaccctgggacgggagcgtccagcgggactcgaaccccagatgtgaaggcgtttctggaaagtccttggtccctggatccagcgtcggccagcccagagcccgtgccgcacatccttgcgtcctccaggcagtgggaccccgcgagctgcacgtccctgggcacggacaagtgtgaggcactgttggggctgtgccaggtgcggggtgggctgccccctttctcagaaccttccagcctggtgccgtggcccccaggccggagtcttcctaaggctgtgaggccacccctgtcctggcctccgttctcgcagcagcagaccttgcccgtgatgagcggggaggcccttggctggctgggccaggctggttccctggccatgggggctgcacctctgggggagccagccaaggaggaccccatgctggcgcaggaggccgggtctgcgttggggtctgatgtggacgatgggacgtccttcctgctgactgctggtcccagctcgtggccgggtgagtggggccctgggttcagggctggtccccctgcgtaagcacctgatatgagctggggaattgggactcaggcctagcgtgtgtcagggggccccagggtctgtgtctgagcccccgttttctccaccgttggtgcttagctgttgggccgtgtctggtattgagcgttataggtgatatgtgagtgtgtgagtgaacgtgatgtggacgagcctgcatgagagctggcggtgcttggagccctgtattcttccccttgaccctgtgtcagcgaggcccctggtccagcccgtgctggccggcaaaggtgtatggccctgtgacatggcgtgtgtccattccatttaggatttagtgtttgggagcccgttcctggttctggtccaacaggtgtcctgggtctggggccaccaggtatgagctcacacacctcatcacagcctctgtgcagcggggacagggcagggcagacggactgaggtgggagctctgttcctccgaccccacctgtctgcctcaagctcccagagcacatgcctgccctgccgatgtgtcctgtttgcttccagggtctctggagggtcgaggaggcagtggccctgcatgggccccagctgagagcagtccactggatgttggagagccaggcttcctaggggaccctgagcttggctcccaggagctccaggacagccctctggagccgtggggcctggatgtggactgtgcaggcctggccctgaaggacgaggtggagagcatcttccctgacttctttgcctgctagcagccaggctgtggagaggaggcgggcggggccggtggatctggagccgtgtgtgtccctgtcgcgtgcttgggcattttattttgggtttgggttgcagctgcaccctaatttgagcgaggcttacaggctgtgagaagaggatagtgaatattaaagagggaaagcagttttcctggaggaagcaaaa

SEQ ID NO: 27560 - DNA, 2099 bp, Homo sapiens
cctttaggacccgaggcaggctctgggcccgccgggtccgttaatctcaccgcgccgcaaggggccacgttttaccacttgatttagcaaccctaagcggtttggaatctgctttgctctcacaggacctcagcccgtcgtgatcagattctcccactttcttttttctttcctggaatggagtgggcagtctttttccatctctaccgaagttgatgttcatttttaatcttttcgcccctcacgcttttgtaataatggtactaagactgagtgttatttagattttattgttgttgtttgtgtttaacgcgaactatttaggcagcccagggataatgctggccatatagagatgcgcctgattaggtctcaggagtcaattcggactgggcagagcactagaatgctgcagggttggcctttggcctaaaccatttctagctatggacttgccagatgagagccagtgggacgaaaccacctgtggcttggctgtttgtcagcacccacaatgctgggcaactatccgccgcattgagaggggccatcctcgaatcctcggctcatcctgcaaaactcccctggatgctgaagataaactcccagtgctcaccgtggtagacatcttagattccggctttgcagctcatcatttaccagaatgtacctttactaaggcccattctttattgtctcagagttcaaagttttactccaaatttcatggcaggcctccgaagggtttacctgacaaaagtttgatcaactgtactaacagacttcccaaatttccagtgttgaatttgaatgagacgcaacttccctgccctgaagatgttagaaatatggttgtattgtggatcccagaagaaacagagatacatgtgagccagcatgggaagaagaaaagaaagaactcggcagtgaaaagcaagtcatttctgggtctctctggaaatcagtccgcaggaacacgagtaggaacaccagggatgatcgtgcctcccccaaccccagtgcaattgtctgaacaattcagttcagatttcctacctctctgggctcaatccgaagcgttacctcaggatctactgaaggaacttttgccaggtggaaagcaaaccatgctctgtccagagatgaagataaaattggccatgatgaaaaagaatcttcccttggaaaagaaccgacctgacagtgtgatttcttctaagatgtttctatctatacaccgcctcaccctggaaagaccagcactgcgatatcctgaacgtttgaagaaattacataacctgaagacagaaggttacaggaaacagcagcagcggcagcagcagcagcagcagcaacagaagaaggtgaaaacacctattaagaaacaggaggctaaaaagaaagccaagagtgatccagggatccagagcacttcacataaacatccagttaccaccgttcatgaccgtctctatggttacagaactctgccaggtcagaacagtgacatgaagcagcagcagcagatggaaaaaggaaccacttcgaaacaggattccacggagagaccaaagatgaactactatgaccatgcggatttccaccacagtgtaaaaagtcctgaattgtatgaaacagaacccactaacaaggacattagtgctccagtggacgctgtgccagaagcccaggctgccaggcaaaagaagatctcctttaacttttcagaaattatggctagcacaggctggaactctgagctcaaactacttaggattcttcaggacactgatgatgaggatgaggaggaccagtcctctggggcagagtgagaagcctctggaggaatagactgaaggcatcccctggggcagccgtgttccaaagcgggatggctggtatcctgagggcagcaacgtttcacataagggcaagaggagaggggcttctgctctctggagcctttaccagggcctgagctctgagcttagggattccattttctttgttcacctctacttgcctctaaaataaatgtaggagaaaaaaaaaaaaaaaaaaaaaaaaaaaaaaaaaaaaaaaaaaaaaaaaaaaaaaaa

SEQ ID NO: 27561 - DNA, 726 bp, Homo sapiens
ctcccaagtcctggaacgggcctccccaccctccggggcaccgacactcacggagtcactccaacttctctgggtgctccgtggagcgaagagcgctctaggacaagcaaggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgggacgacttagcttctgtattattgttgcttcctcagggggagacagtcaagaataaaaagtattctaccacctaaaaaaa

SEQ ID NO: 27562 - DNA, 2333 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 27563 - DNA, 1153 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 27564 - DNA, 1284 bp, Homo sapiens
cctatggctccgaagtccccgctggcatcctgaaagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 27565 - DNA, 2279 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 27566 - DNA, 1390 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaaaaaaaaaa

SEQ ID NO: 27567 - DNA, 902 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 27568 - DNA, 3019 bp, Homo sapiens
ttgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagagctactgaaacataaagatagaatcacaacctttagagagttaattgctaaggaaaaagcatttcaagatcatgctattaaggtattccaaggagtatgaaatgattgaaagtgagaacaaatatatttaatctcaggtcatagactgtgattcagatgaagccaagagtatcagagatgtacctacccttctgggagccaaactggataagtaccacagtctaaatgaggagcttgatttcttgatcacaaaactgggacatctcctagagtcaaaagaaaaccactgcaacagactcattgaagaaaatgacaagtatcaaagacatttaggcaacttaataaagaaggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcaggtgatatattaaaatctgtataaagggtaaagtcttacattccaaagatgtgattacttttcttctaatttcttcctgtgaataatcaaatatattctatttaacataaacggaaaaaaaaaaaaaa

SEQ ID NO: 27569 - DNA, 2865 bp, Homo sapiens
tggatgttctgtgctctcaggaaggcgtgttgagtagccggcacggcgaggcccgtgctggccgtttcttcccggagttttcgtttctgtaccccactttgtgtttactgcggcaggaggcgccagctagcccacaggctgttcggcctagggggtcgtaccttcctaacttcaccactctctgggaagacaccgcacccacagtagggtcgctcgggcctcgcgggctgcacctgtctctgcggagttcccccggcgcgggcggacgtcacacaggggcgttccagcactccgggagcccgattgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagaggtcatagactgtgattcagatgaagccaagagtatcagagatgtacctacccttctgggagccaaactggataagtaccacagtctaaatgaggagcttgatttcttggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaagggtaaagtcttacattccaaagatgtgattacttttcttctaatttcttcctgtgaataatcaaatatattctatttaacataaacggaaaaaaaaaaaaaaaa

SEQ ID NO: 27570 - DNA, 1288 bp, Homo sapiens
agaggcgcagagagagctgggagctaaggggtggcggcgaccggaagcgcagtgcacacccccatggcccgggctttggtccagttctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggtctgcaaaccactcagaatggccgattctatgccatctctgcacgcttcaaaccgttcagcaataaagggaaaactctggttattcagtacacagtaaaacatgagcagaagatggactgtggagggggctacattaaggtctttcctgcagacattgaccagaagaacctgaatggaaaatcgcaatactatattatgtttggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtatgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttagtgatccccattggatataaggatgactggtaaaatctcattgctactttaatctaaaaaaaaaaaaaaaa

SEQ ID NO: 27571 - DNA, 3473 bp, Homo sapiens
accttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttgactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccttctctgttcgctgctgtcagcataatgattgtgttccttccctatgggatccatctgttttgtaaacaataaagcgtctgagggagtgt

SEQ ID NO: 27572 - DNA, 3232 bp, Homo sapiens
gactggaggcgcgcgacgcgggcgcaatggcggggacccggggcttgatgctgcttgggcctggcccagtggcgggtcctagggacgtgggtacctgcagaggccggcagatggagattcagaaacataaggacaacaagaaacttccccaaggtatcattatagtctttagacttcagacacacaccacacctcaaatatatacacaactgaaaggaaaattaaggaagtttttcaaagaaccctattccgagtaagaagtgtgttgcatgaatttctaagaaatgtatttctcacaagtctggagatgggaagtcaaagaccaaagtaccagcagaatggttgtctagtgagggccctcttcctcctagatgacagtctttgcactgtgtcctcaagggtagaaggaatgagccagctctctggggtctcttttataaaagtgctaatcccagtcaagagggctctgccaggggccctgcctcccaatattatcaccttggtgctaaccaatattttctaacttccatttgctactctaatgttaactctgttatctcaattttaataataataatagctgacatttgctgatgacatgccttacactgcattcattaacatctcaatctcatttaatttgaaagagataaagcaacagccaatacacacattaccactttttttcctatcctgttacaaaggagatgaggttgtgggagaactctctttaggcattgttcacatcaggacacttgagaaacagatccttcatatcctttggacaactcttgtacttcagttggctttaagcattatcagagcatccttgacatgatgccaggtcctaacaccgcttcagtgaaagctcagagacaagcaaaagataattgatctattttgtgccgcatgacatactcgatgagcagcaacatatactgtggtgtttggcctccataaactgcagagaaattgaaatatagtaataaactttatgcacggacaaagggtgacctaggatatcactgaactcttctgccttcataaccaaatgtcaaaatgctaatagtctgttccttgtggaaaaatgttgagttttcattcgggagatcaggacttacacactaactcaacctacagtagacacttgctagagaataaaacacaataatgcacgtagaatcgttctgtaaactgtaaagaattttacaaatatgaaattttattatggttttagtcttgtatctattaaatgtatacctattagcatgcacacttttttcttctagcatcaaaggttgcttaaaataacagtggaacatttaaaagcaagagaattctaatttaccatcattcaaattatgttaaatccaactcaactttataagctaaggaacatgtgaaggataaataaaaatttgatagttaagaagataaatatatgcagagaaattatgtgatgagtcaaattgattattacaggacaatatactgtattaataaaacagactaaatttaaatgtattgtgcaatggcaaacctagtgccttcttggaaaaacatgccttaacaagctcatgtggttgcaaggttgataatatcttgataataacttatgttgttcttattcctagtaattgctggcctccttatgaccttccgcctagtttcaggcagtagctaggagagctagactaactgctccagagaagtgaggccaaggcatgcaacagagtcacttctccgcttttccatttcaaagtagacaataggggaagatataacaaaagccaaaatttatgcagtaaagaaaaaattggggaagaatgcaattaatgaaagacctacactatacaaggatttcactggacgaagtgaagaatagggagcttgtaaagaagatcaagatagttggacaggtggaatgtctccaagacctttccactcgcctccccacttgttgagcatgggagctgggcaaatggatgatagaccatccagataaattttggcatctaaaagtaattgtcacttgcatcttgtttctcaagaaggaccttgaaagtaagcaaactcctagagctccctaatcccatgcaccacattggcttggagcagcaacagtagcagtagaatagcagagcagggggactcaaggccaagacggtcttgttacaggcaactccctgagcctccttccatccgagaggtacctgagaacctctaaaaatttcatttccccctgaaaggtgagaaagtgactgagagagggctgataaactagggtcctccaggtcgggattgggaaaattcagaatatacatggataaagaaccagggactggccatgataggacctacacctattacttcatatgacttgctaataggagtcaatgctgacagccatagaccttcctgggcttctccctggggcctcaatttcagtccagcgttaagaacttagttttggtctcagggagaaggatagggagatggaaattttacctgagtttaaaaacctgaatttatgcagatatgacattttctggatacattttgacaagagtagaactaggggaatcaaaatagagattatgttgagtaacagggaaatagagttacagttcttgcctatcatctgagtatatggactgaaatactgtacctgctacatacattgtaagcaaagtgaggtcatggccagagcccaagggtttgaggagccttctatgacgtgatgagatggtcttgggtcccctatatgattagcttgtggtggtacattaggactaaatattccaaatgcattaacataaagctgaagtgatgtccttagtgaacttggtcttaaaaattaagagcattttggttgggtgacctaccaacaacatacagggaagagatacaggatcttggttgactctcactgcagtagacattgattttgtggtgtagcagcttgtaaaattaatgcaaatttgagatgaactaataaaaatatagttcatgaaggtgccccactacttgccctacctctcctctcctgttacaatagatcacccatctttgttcccatctgaggactcaggtaatggacttcatctcttcttgtcttctcaaggattttgcatctgccattatcctttctccctcctgtatcctcagttgttttcttctctactggatcaatgtcatcaacatacaaatattatctagtatttctcatatt

SEQ ID NO: 27573 - DNA, 756 bp, Homo sapiens
cgcgacgcgggcgcaatggcggggacccggggcttgatgctgcttgggcctggcccagtggcgggtcctagggacgtgggtacctgcagaggccggcagatggagattcagaaacataaggacaacaagaaacttccccaaggtatcattatagtctttagacttcagacacacaccacacctcaaatatatacacaactgaaaggaaaattaaggaagtttttcaaagaaccctattccgagtaagaagtgtgttgcatgaatttctaagagccagaaaatgcatgacacaggagaagatgtaccctcatctgttcagtgagagatgtgcaaatcaacatcaacacagaactgctgaagaaaaaaaatatgtctctgaaaagcaacttattcactggagatgtgaggagccatccgcacatcacaattctatagacatcaaacgcatgaagcatttcggatctgctttaagactgaggcagactttccatctggacacagccgaccatccatgtgtcattacaatgaatccagcacttccctggaagctggaagggtcaaattcaacttcaactctgccacttcctgcttaacttgctgtttaaccttgggcaagctgccatcccacacgaggccgaaggtgtcggtttttaaaatacagaaatttggttccatgagggattatcaatatactgctggtgggccaaattccatctgctacttgcctttgtaaataaagttttattgaaacacaaa

SEQ ID NO: 27574 - DNA, 8630 bp, Homo sapiens
agatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaagagttcaggaatccaatgctttgagaaataagaaaaactctcgtcgagtcagctttgcagatactataaaggtattccagacggagtctcatatgaaaatagtgagaaagtcagaaatggaagaaacagaaacaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatatggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtgggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgggtgtgagccaccacacccagcaatgttttcttaataagtatagtttttctagggaaagttaattcatttttgtctagtacatatatgtaaatatattaatgttgtttttgtgtttgtgatgtagtaaggagatgtacatagaaattcattgaggtatatagatactcatctgtctaggcagttcccaattttctgaagaatgttttacagcaaaattttctattttcttttattaaatagtgacacgtcaaacaatgtcacatccaaaacactagtttcatcaatttctagcagtaataatagacttgctgtaagtattgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtcctgtggatcccctgaatgttattgtccctcttgattggtttttacttctgagctatacgtcaaaagacacataagcttcaaaagtcaagacaaacctcatttgccataaaaatcaagatatagatgttctgttccgtaaactccttgaaaaacattttaaagtcatcaatatgatctgtttcccatgaaacttaagttagctttcttattggagttatttcttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgaaagtttttctttcattggttggaaagcagattacattttgcactattaaaataagtttattactttaaaaaaaaaaaaaaaaaa

SEQ ID NO: 27575 - DNA, 8708 bp, Homo sapiens
agatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaagagttcaggaatccaatgctttgagaaataagaaaaactctcgtcgagtcagctttgcagatactataaaggtattccagacggagtctcatatgaaaatagtgagaaagtcagaaatggaaggctgcagtgcaatggtgccatctcagctgcaacttctgcctcctgggtttaagcgattctcctgcctcagcctcccagaaacagaaacaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatatggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtgggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgggtgtgagccaccacacccagcaatgttttcttaataagtatagtttttctagggaaagttaattcatttttgtctagtacatatatgtaaatatattaatgttgtttttgtgtttgtgatgtagtaaggagatgtacatagaaattcattgaggtatatagatactcatctgtctaggcagttcccaattttctgaagaatgttttacagcaaaattttctattttcttttattaaatagtgacacgtcaaacaatgtcacatccaaaacactagtttcatcaatttctagcagtaataatagacttgctgtaagtattgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtcctgtggatcccctgaatgttattgtccctcttgattggtttttacttctgagctatacgtcaaaagacacataagcttcaaaagtcaagacaaacctcatttgccataaaaatcaagatatagatgttctgttccgtaaactccttgaaaaacattttaaagtcatcaatatgatctgtttcccatgaaacttaagttagctttcttattggagttatttcttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgaaagtttttctttcattggttggaaagcagattacattttgcactattaaaataagtttattactttaaaaaaaaaaaaaaaaaa

SEQ ID NO: 27576 - DNA, 1338 bp, Homo sapiens
gaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatttaagaggaacgatgatgaatgtcgggcatttgtgaagagagtcataatgagccgtttctttaagataattatgattagcactgtcacatcgaatgcgttttttatggccttgtggaccagttatgacataaggtaccgcttgttcagacttcttgagttctcggagatcttctttgtgtccatctgcacatctgagttgtccatgaaggtctatgtggaccccatcaactactggaagaacggctacaacctgctggatgtgatcattatcatcgttatgtttttaccctatgccctccgccagctcatgggcaaacagttcacttacctgtatatcgctgatggcatgcagtccctgcgcatcctcaagcttatcggctatagccagggcatccggacgctgatcaccgccgtggggcagacagtctacaccgtggcctctgtgctcctcctgctcttcctcctcatgtacatcttcgctatcttgggcttctgcctgtttggatctccagacaatggtgaccatgataactgggggaacctggctgcggcttttttcaccctcttcagcttggccacggttgatggctggacagacctgcagaagcagttggacaatcgggaatttgctttgagccgggcattcaccatcatcttcatcttgctcgcctctttcatcttcctcaacatgttcgtgggtgtgatgatcatgcacacagaggactccatcagaaagtttgagcgagagctgatgttggagcagcaggagatgctcatgggagagaagcaggtgattctgcagcggcagcaggaggagatcagcaggctgatgcacatacagaaaaatgctgactgcacaagtttcagtgagctggtggagaactttaagaagaccttgagccacactgacccaatggtcttggatgattttggcactagcttacccttcatcgatatctacttttccactctggactaccaggacacaactgtccacaagcttcaagagctgtactatgagatcgtgcatgtgctgagcctaatgctggaagacttgccccaggagaagccccagtccttggaaaaggtggatgagaagtagctgggcatggggcacccatgtgccgagagccttgcagaccatgacaggtccctattaaacacaggctttctga

SEQ ID NO: 27577 - DNA, 2233 bp, Homo sapiens
cgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaatgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataaaaaaaaaaaaaaaaaaa

SEQ ID NO: 27578 - DNA, 4658 bp, Homo sapiens
gcggccgcggcggcggcgaacactccctccgaaagagaagcgcagttctccaaagggtagggactctgggcggggctagcagtcctattccgcaaccgcctcagtctcggccccctcaggccaggcgtgagcgccgcccgcctctccccctgacggcctccggttcccatggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatggaaaagaatgaaaagataaggagtctagaaaccaatattaatacagagcatgagaaaatttgtttagcctttgaaaaagcaaagaaaattcacttggaacagcataaagaaatggaaaagcagattgaaagacttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaaggagaaaatgtgtaattcaaagaagatactgatgtgttgaaaaaatggaatttttggtactgtgctgtttacttattatatgtagctcatacttcatagaagctgttattttgcttttgaataaattttatatttcaatattttaaaagaaagcccttctaaaacttaattatatttttaaagaaaatttattattttatttattgttttttggcttaaacttgctgctttcttttgctttttatataaaa

SEQ ID NO: 27579 - DNA, 2086 bp, Homo sapiens
agcgcggaggcttcggagcgagccggggcagtcggggtcggtgaggatctcctttagaagaggagaagccttgcatcaacctcttgggcctcagccaagatgtctgagataccgtccactatagtctccaagaacatgaccaatgacaagaacagcctggaatccatgaacatcagctcttcttcaagcactgaagagaacccagagaaacaggcaagaaaaaacgaagaacatggtcctgacccttcagcgaaccctttccacttatctggggatgtggatttcttcttgctcagagatcaggagcggaataaggctctctccgaacggcagcagcagaagacgatgcgggtgcaccagaagatgacctactcctcgaaagtgtcggctaagcacaccagcctgcggcggcagctgcagctggaggacaagcaggaggacctggaggcgcgcgccgaggccgagcatcagcgcgccttccgcgactacacgacctggaagctcaccttgaccaaagaaaagaatgtggagcctgagaacatgagtggctacattaagcagaagcggcaaatgttcctcctccagtatgccctggatgtcaagcggagagagatccagcggctggagacgctggcgaccaaagaggaggccaggctggagcgggccgagaaatccctggagaaggacgccgccttgttcgacgagttcgtcagggagaatgactgcagctccgtgcaggccatgagagcggctgagaaggagaccaaagccaagatagagaagatccttgagatccgggacctcaccacccagattgttaatatcaaaggtgagatctccagatttgaagacactctgaagcattacaaggtctataaggatttcctatacaagctgtcgcccaaggagtggcttgaagaacaggaaaagaaacactcgtttctcaaaaaggccaaggaggtctccgaggcttccaaagagagcagtgttaactccacaccaggggacaaaggaccagggatcaagggcaaggcgagctccatgtgggccaaagagggtcagggtacaaagaagccctggaggtttctgcagacgatgcggctggggcggagcccgtcttacctgagcagcccccagcaaggcagccagcccagcgagtccagcggtggcgactccagagggtcgaactctcccatcccccccacgcaggaggacaccgacagcgatggggaggaaccacagctgtacttcacggagccccagcagctcctggatgtcttccgagagctggaggagcagaacctgtcgctgatccagaacagccaggagacggagaagaccctggaggagctgagccacaccctgaaacacacccagatccgcatggacagggaggtcaaccagctgaagcagtgggtcaccacaatgatgatgtccatcaccaaggaggaggacacagcagctgagctggagctcaaagcccgagtcttccacttcggcgagtacaagggcgatcagcaggataagctgctagagagcctgaactgcaaggtgctggatgtgtaccggcactgcaccggcacccagcaggaggccaacctgggcaccgtgcagatgctgaccatcattgagcaccagctggatgagctgctagagaacctggagcacgtgccccaggtcaagatcgagcaggccgagagggcaaaggagaaggagcggcgcatcagacttcgagaagagaagctccagatgcaaaagatcctacaggaggagcatctgcagcgggcccgggcgcgcgcccaggctgagatcaagaagaagagaggcaggacactggtatgccgctcacgacccccagcccacaggatcaaacaacagtctgagcacacactgatggacaaggaggaggaggagctgctatttttctttacttaatcttcgcagaccatagctgttctggctgaaggcttagcaaagatgttggcagaggaagcagagactgggctgggtctcgagtggcccaactgagtcctctctgtctcctgtgtgctcccttcctcacctgaataaattcatgtctctctgg

SEQ ID NO: 27580 - DNA, 3330 bp, Homo sapiens
atgcagggggcgccacgagctcgtttcggaagccggaccccgcccgcagccgccgcttcgtcgtcgtcgccgtcctgcacgcccgccacatcccagggccacttgaggactccggcgcagccgccgcccgcgtcccccgccgcctcctcgtcgtcttcgttcgccgctgtcgtcaggtatggcccaggcgcggcggcggccgccggcaccggcggcacgggtagcgacagcgccagcctggagctcagcgcagagagtcgaatgatcttggatgcctttgcccagcagtgcagtcgagttcttagcctcttaaattgtggaggaaaactcctggactccaaccattctcagtccatgatttcttgcgtaaagcaggaaggctcaagttacaacgaaagacaggagcactgtcacattgggaaaggggtccacagtcagacctcagacaatgtagacatagagatgcagtatatgcaaaggaaacaacaaacttctgcctttttgagggttttcactgactctctacaaaattacctgctctcgggaagctttccaactccaaacccctcgtcagccagtgaatatggccatctggccgacgtggatcctctgtcaacctctcctgtgcatacattaggtggctggacttccccagcaacgtccgaatcccatggccacccatcttcatctacactgccagaagaggaggaggaggaggacgaggaaggctattgtcctcgatgccaagagctggagcaggaggttatttcactgcaacaagaaaatgaagagctcagaaggaaattagagagcatcccagtgccctgccagaccgttttagattacttgaagatggttctgcagcaccacaaccaactcctgataccacagccagctgaccagccgacagagggaagcaagcagctgttgaacaactatcctgtctacataacgagcaaacagtgggatgaggctgtaaattcttcaaagaaagatgggagacggctccttcgatacctcatcagatttgttttcacaaccgatgagcttaagtactcatgcggccttgggaaaaggaaaaggtcagtgcagtcaggagagacaggtcccgaaagacgccctctggatccagttaaagtaacatgcctccgaggtactgcatccttccgctcagtgtcaccatctgtgatctcatttcaccgcattggctgtggctctccccgtacaagtgttcagccttctgtattttgatttctttctgctgagaacgtctaggcttcatgtggcccatctactcagtcttgagaagctcttttaaaaacctccgtttgccttagcgttgttgttctctcttagtggtacataagcatcgcatagcacctcatgtttcacgcttcaaattcagattttctttgctgccagagaaggccacctccagcaaaactggagcataggggaacacacagaagaagggaaggtgtggaaaatttttttaatgggtacaatgttacctcatttccagttctagtttgtgtccccttctaataccttctcaagaatacttggcccaactccttaaatttgtttaggattaattctccttaatgctaaaatacaccttgcccagtagaacatttctcttttggttaaaaaaaaaaagtttctattaagtgtactgcagagataatacgacttcagcagtattaatagctgattactttgcagttgatctgcactattgtaggccaggcagaggggtgggaaggaggaatcaggaggtatccagttgattcagcaagtgcaaatacagagctagacaaatagaagtgttatagtgccaacaaaacattgttcacacctgaaaaatccatatcaaaaagctcaatattaacctatacagttcagtggcagttttattggctggaaagacttaatattgatttactgaaatagggataaaaatttttcctggtgaggaaatcacagtaaaaaaaaaaagccggattatcactgctaaggccctagttattggaaagaatactctacttctgcactccctcctgagatgctcacagtgattctggacattatgtgcctaggatgcatatgtagtttttgttagcagctgagattccctaggcctacccccagacattctgattcagaagggatggggcaggcatgcgtggttcctagatcaagacaaccttaggggcgtatgcacacatggcccacgattcaggaagccacctgagacgaaaatgcctgtatttactaggcacaagtgctccagcacacctcctattagttggtctgaatattccacttactcagagtgactaagtggcagaaatttccagggtctgtcctgccaaactagccatagttttctgtattccctgacatcatcagagatgatggagttactctccaaggggcagtgttgagcttgggggcttgactgagtgccctgtctgtgtgtactcaagggagttgcctttgggcttataaaggagccaaataaggggtctcatcgctgtatcattttccagaaattcttactcaacattttacatttctatagcaagtcagtagaactgatggattaaaatacatcccagagaactagtgctgctgctctggaaacactgcaggagccactgtcacactgatgcctgatgcagtccaggctgcctaaccagagactgctgtctccagctcatttttcacttagggccacaatgcgtggacctccatcccgcttttggttgggaaatacgtaggcaagatatggtgattatctgtgttggaggcagctgcgacagttcactcttctgggcatgttaattgctttttggtaaaattaaatatttagaggagataacacgtaaaaaatatttgtcagcccatgtatagaaatgacattttcagaaataagtatagctaatcacacaacattctaagaacatgggtaccttttctgaactaacacttaggcacctcctcagtcattaagactgttattttattgtactctatcttcaaattagtagctggttaaagaataccatgctaatggtatttgctgtgcttctggagatagtaacattctcaaaatgtgagcaggtaacaacttgggttttgaaatctgtctccttgacttacaccagacatggtgcatcccatgccttacaaatcaaatttaccttttatttcaacagcaaatgttccttagagggattaccctctatatctgtgtaatttttttttttacttttgcacatgagaagaaaatttgtatggaataaattgggtctaatgagtgacatc

SEQ ID NO: 27581 - DNA, 1374 bp, Homo sapiens
gttgctaggtaaccacatctcccataactgccccagcacatcgtcctgagccgcccaacctgtctccagccaccttctgtggagtctcaaactccatcatctgtgggaccctgtaggccgaagggagaaacaagagtgcagccaccacccctgagccacctgtggctctgctacccacaatttcactgtgaagagtcagctgcctgggccgtgaggtcactgccaccatgagtctgggcatcatggaagaggaagacctggccgagtacttccggctgcagtatggggagcggctgctgcagatgctccagaaactccccaatgttgagggggcgtcggagtccctatccatctggctactggagaagaaaaaggagacagaaatcatgcatcaaactatggtgcagaagaagaagatgtttcagcgcagaatggaaaccctgaacctgcgctgggaggaactgggcgttaaggaagcccaactgaaggctcacatccagaagtctgagcagttcatccaggagaacgaccagaaacggatccgcgccatgaagaaagccaacaaggagcgagaactcaagtgccagcacatgcaggagctgaccaagcgcaagcaggagatggtggcgctgcggctggagcaccagcggctgagcgccaagctgaaggactactacatcttcaacaagtacctagagaaggtggtggagaactccgagttcgaggagatccatgaggtgattgcacgctacaagacgctggtgagcatgcgccacgacctcatgcagtctgcgcaggaaggccaggagaagattgagcgcgccaaggcccggctggcgcgctacatggaggaaaaggatgatgagatcctgcagcaaaacaatgagctggcaaggctgcagatgcgctttgaccgtgcccgcagcaatgtcatcttctgggaatctcgctgggcgcacatccagaacaccgcagccaagaagaccctcctgctcggcaccattaagatggccacgctgaacctcttccagatcgtgagcaagcacctgaaggaggtgactgaggtggcactggaggacacccacaagcagctggacatgatccagcaatttatccaagaccggtcggacatctgggcagaggtgaaaaagaaggaacaacagcgagtccggatttaaggaggcagccttgttccagaatgtcctgagacagagatcgtgaaagaagaagtcgtgagcctgcggtccagtcagtccagctcgggaccgatgcctgctgtgccttcctgctgagggacacctgcttattttcccccgtgggcctcactctatccctgaaaacagtgaatgttatatgaagtttgttctcaagttc

SEQ ID NO: 27582 - DNA, 1258 bp, Homo sapiens
cccccacctaagagattgtggtggggaatctcagacactctaaccctctgggcccaagtcacctttctatcaggggagggaggctgtgctctcactggcttcttgttagaagttctgcctgccctacagcctgcactgagggctctcatcactgcttctgagatcttaatgggggtcaacgaagatgtgggcttctctgagtttagaccatccatctgccaaggaaaaccaagccctgagactgatagagatgagagaagagaatggtaatgtccccaagacagagcaggcaggaagtttgaagcctctgagggatacaggaaaatctaacctcaaagagaagaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattattttgtacttaaaaaaaa

SEQ ID NO: 27583 - DNA, 3511 bp, Homo sapiens
ggcctggggggcgcgcgcccctggggtcccggcgctgcccgctgtggtgtccccggcaggcagagcgcgatccaggccgggacgacttgggaaagttctaagtaaagtttgatcagccggtttgatcggtctgacgtggtccaagagtctgacccaagggtttgcgactgggagaggaaatctgtgtcctggacaagattggattatggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacagcagggaacagtacactgggaagctccgagtgagatcacactccttgagtccaactcacagagaagatggacaaaatattaccccaaagatttgtgaagtttattcgaaaaaatctcctgtttctttggatgatagtgacattgaagctcgccttaatagttggaatcttgggatagaaaatcctcgatacctgagacagaagcctatcccagtttctctgatgacaccgaaattcagcctgagaaaatccagcagtttccatgatgatcattttctctctcgaatacgtgagaaagagctggacatgaaaacaaaaatgatggaagctaaatttcatgaagaaaagcttaaactgcaacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattattttgtacttaaaaaaaa

SEQ ID NO: 27584 - DNA, 1294 bp, Homo sapiens
aatgattaccatatgaaagattccatgcagttgactattatttcacagagctctctggttgggctgctctataagaagctaatcacctaacagtgtctattgctgtggctgatgatttccagagtgttctaagatgttatcaggaaaggcatccaacaaatagtaagagaaggaccatttcatttgtacattatttcttcctgtgattctgttttccaacaccttgcctcttgtttcaccatgaaagatgtacacacttcacaccaaaagggtaaaagctgctgctaggcagatgtggacttcaaatctctccaaggtcagacagtctcttaaaaatgtttaccacaaatgtaagattcggcaccaagattcaactggatatcccactgtgacatctgatgattgtaatcaagatgatgatagttatgacggaaaaatgaatcttccagtagtgctccaagatgttaaaactgctcaagttgaacttttcagccaaatgactgacattgtccatatgataccaaaagtccaggaaaagactgacttgtatcaaaaacagatggaggtcctggaaaccagaatgaatgttaatgaagacaaacaatgcacaacgactaaagatatcctctctatgaaagaagacatcaaggcattaaagaagaaggtgacagaactggaaattcagaattcctgctccacgatacattgtctagagattctggagggagaaaggggtaaagaaatcacagaactgctttacaaactcatacaaccagcaactctgaagaacactttggcctctacagacatggaaatctcttcagcagaaccagagaaagtgcccagttatccaaagtccactgaccatcttgagaaaaaaacaatttctccccaaatgaaaactctgaagaaacgtaaccatcaaaatgcatcaaggagctttgaaaaagcaaagccaaatatttacatttacccagacttcagtacatggatcaagctaacttttgttcatggaggaaaatggacatttttcctcagtgctaccaagttagaagaattcatccagtggcttctttctaggccaaccattcttcctgaggaaccccaggtcataacccagagatactgtccattcactgggcccattttgagcttgaccacaatctgtctctccatcttcaacaatatttacggctttatttgttccttaaaagaagaagtaactcgactatagagttatgttctgctttgcttggcacaaaataaatgtaacctggaggctccaagtattcac

SEQ ID NO: 27585 - DNA, 3044 bp, Homo sapiens
ggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaataagtcagaggtcccagaagagtcagctcaaaaaaatacctttgtcagttattgaaggaaacaaaaggcaacttcagtattcatcgtgatcacgaatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaacccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaaaaaaaaaaaa

SEQ ID NO: 27586 - DNA, 1945 bp, Homo sapiens
agcaagcagtcctcccggcaccgtcggaagcgcagttgcagcagccgtcggacaagcggcccgagcagccacggacaagcagtccgggccccgccactgggcattgcagagagacagagagagagaggaaggctcactggctttgagctctctgggtacagtgtctgagtggaggcaaagtgcggttccttcaagatgtctgtgttgaagaagaacaggagaaaagactccgacactccccaggaaccttcggagaaggccaaagagcagcaggcggaggcagagctccggaagctaaggcagcagttcaggaagatggtggaaagccggaagtcttttaagttccgaaaccagcagaagattgcgagtcagtacaaggagatcaagaccctgaagacagagcaggatgagatcaccctactgttgagtctcatgaaatcctcgaggaacatgaatcggagtgagaagaactacatggagctgcgactcctgctccaaactaaggaggactatgaggcattgattaaatccctgaaagtgctgttggctgaactggatgagaagattcttcagatggaaaaaaaaatcgcaaaccaaaaacagattttcgcaaaaatgcaggaggccaataacccccggaaactgcagaaacagattcacattttggaaacccgtttgaatctcgtcactgttcactttgacaagatgctgaccactaatgccaagctccggaaggagattgaagacctacgatttgagaaggctgcttatgacaatgtctaccagcagctccagcactgcctgttgatggagaagaaaaccatgaacttggccattgagcaatcttctcaggcctatgagcagagggtggaggccatggctcgaatggctgccatgaaagaccgccagaagaaggacacctctcagtacaacctggagatccgagagctggagcgtctctatgcccatgagagcaagctcaagtccttcctgctcgtcaagctgaatgatcgcaatgaattcgaggagcaggccaaaagggaggaagctctcaaggcaaagaagcatgtcaagaagaacaggggagagagttttgagagctatgaggtggcccacctccggctgctgaagctggctgagagtgggaacctaaaccagctcattgaagattttctggccaaggaggagaagaattttgctcggttcacgtatgtcacggagctcaacaacgacatggagatgatgcacaagaggacccaacgaatccaggacgagatcatcctcttgcgatcccagcagaaattgtcccacgatgacaaccactctgtcctgagacagctggaggataaactgaggaagaccacggaggaggcagatatgtatgagagcaagtacggggaggtcagcaagaccttggatctattgaagaactcagtggagaaactgttcaagaagataaactgtgacgccaccaagatcctggtgcagttaggggagacggggaaagtcactgacatcaaccttccgcagtattttgccatcattgaaaagaagaccaacgacctgctgctgttggagacctacaggcgcatcctggaagtggaaggggcagaggctgagatcccgccacccttcatcaaccctttctggggtggctctgccctcctcaagcccccagaacccatcaaagtcatccccccagttctgggggctgaccccttcagcgacaggttggatgatgtggaacagcccctggaccacagcagccttcggcagctggttctcgacaattatatcctgaaggagaatcggagtaaggaagtgcgcggagacagcctgcctgagaaggtggatgacttcagatccaggaagaaagtaaccatgtgaggtgcatgcatggggccacctttgcaacataaccgaaagaataaatgttttgttctgt

SEQ ID NO: 27587 - DNA, 1670 bp, Homo sapiens
agtagctattctcttctccctgaagggaggcaacactgtccgttcgcctgactggcagtgttttaaggacccatcgcgcttgacgggaaagtcaggtacaagctgatgctgttatcaccacaggaaccaggggctgagcggtgaaatccagctcctcccagctggaagacactagggtgaacggagataaaagcagttctctttacccgaagtttatttctttttcatgccacttcaaatttggattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcagaaataatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatggtaatatgctgacatcattcaataaattgaacaaagagattaaaaaaaaaaaaaaaa

SEQ ID NO: 27588 - DNA, 1939 bp, Homo sapiens
ggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcagggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagagctgtaaatgatcaagttttgttagatgctgaatacaaacagatgcagtgtgattttcagttgttatcagaagagaagttggtgctggaaaatgaactacaaaagttgaaggacaaagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatggtattgcttacaataaagtacatttttgctctttacaaaaaaaaaaaaaaa

SEQ ID NO: 27589 - DNA, 2173 bp, Homo sapiens
ggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagagctgtaaatgatcaagttttgttagatgctgaatacaaacagatgcagtgtgattttcagttgttatcagaagagaagttggtgctggaaaatgaactacaaaagttgaaggacaaagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatggtattgcttacaataaagtacatttttgctctttacaaaaaaaaaaaaaaa

SEQ ID NO: 27590 - DNA, 1134 bp, Homo sapiens
aacctttcaagtgccccctcctttccttaaagtcttttataggggtccccttcttggccatctccatcctgtgagtcaggactgaaagggcacagacaggtcactgccagcattgttggggcaagcctgcaagcacgcatcactggggatctgacatgacaatggccgcctgccccctctgagggctacaggacttaccccagtgggaagcagctaagcaggtctgaccagccgacctggacctggccaagggtcctgtcatccctcatggccaccccgccattccggctgataaggaagatgttttccttcaaggtgagcagatggatggggcttgcctgcttccggtccctggcggcatcctctcccagtattcgccagaagaaactaatgcacaagctgcaggaggaaaaggcttttcgcgaagagatgaaaatttttcgtgaaaaaatagaggacttcagggaagagatgtggactttccgaggcaagatccatgctttccggggccagatcctgggtttttgggaagaggagagacctttctgggaagaggagaaaaccttctggaaagaggaaaaatccttctgggaaatggaaaagtctttcagggaggaagagaaaactttctggaaaaagtaccgcactttctggaaggaggataaggccttctggaaagaggacaatgccttatgggaaagagaccggaaccttcttcaggaggacaaggccctgtgggaggaagaaaaggccctgtgggtagaggaaagagccctccttgagggggagaaagccctgtgggaagataaaacgtccctctgggaggaagagaatgccctctgggaggaagagagggccttctggatggagaacaatggccacgttgccggagagcagatgctcgaagatgggccccacaacgccaacagagggcagcgcttgctggccttctcccgaggcagggcgtagccagcatgcaggtgcagggccctgtggtccagactcccctgggttgggattcaagtccagggtgagcccatgtgctggagaaaatacacactcattggtctccttgctttgaaagatccaataaagtcctgaggcaaggtttggaaaaccaacttaaaaaaaaaa

SEQ ID NO: 27591 - DNA, 1743 bp, Homo sapiens
ggtgttgttccggacacatagaaagataacgacgggaagagcggggcccgctttggggtccaggcaggttttggggcctcctgtctggtgggaggaggccgcagcgcagcaccctgctcgtcacttgggatggagaccggctttcccgcaatcatgtaccctggatcttttattgggggctggggagaagagtatctcagctgggaaggaccggggctcccagatttcgtcttccagcagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgacaaaaaaaaaa

SEQ ID NO: 27592 - DNA, 1828 bp, Homo sapiens
ggccgaggctcaagagagcgtggcgtcgcattgccgtttttgctcagaatcgcgactaaggctttttttttttctccctctgaacggttaggctatggctgcgataaaggccgtcaactccaaggctgaggtggcgcgggcccgggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctggtttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtcttaaaaaaaaaaaaaa

SEQ ID NO: 27593 - DNA, 11073 bp, Homo sapiens
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgaaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggtgagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccagggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttg

SEQ ID NO: 27594 - DNA, 2022 bp, Homo sapiens
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactcttaaaaaaaaaaaaaaaaaaaa

SEQ ID NO: 27595 - DNA, 836 bp, Homo sapiens
ccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgac

SEQ ID NO: 27596 - DNA, 1309 bp, Homo sapiens
cgcccgggcaggtttcaaatccaggcccctgactctaagctgaaccatgagaatctgctgcctcccaactaactaattatctacatgggttctacgcagtatgatcctttgggccctcaggaactctcacattcttttggcctgattcctgcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagccgtgaaatgcctgttctttgaccagtggcatctcctctcaggaagcactgatggcctggtcatggcctggagcatggtggggaagtacgagcgctgcctgatggccttcaagcatcccaaagaggtgcctgacgtgtcccttctcttcctccggatcatcagcgcctgtgcaaatggcaagatccgaatttacaatttcctccatgggaactgtatgaaggtgataaaagccaatggcagaggcgatcctgtgctgtccttctttattcagggcaacagaatttcagtctgccacatcagcacatttgctaaaagaattaacgtgggatggaatggaatcgaaccaagtgctacagctcagggaggaaatgcctccttgaccgagtgtgctcatgtgagactccacatcgcgggacacttaccagcatcgaggctgcccgtggccgctgtccagcccatgacaggcgggatggccccaaccacagctccgacccatgtgttggcaatgctgatccttttcagtggtgtgtagcagcaggtatacaggaaaatgttgaagagccccagggctcctgtgagtggattcacccccaaggtcagaatggcaactcctggaacagcacaacaagtggcaaaggacacagctagcaacgggctggaaaaaggcagagaacgtgggagtgatcatctccaactcaactcaatcatactacctaaaatcggcactgacaaagtacaaataatccacctatccagtagaggcagcactgatctggctgaattcctggatatggggaatcctcgggatgaaacaaacttacaataagaaagaatatgtttgtgggaaaataaaaaaaaaaa

SEQ ID NO: 27597 - DNA, 2489 bp, Homo sapiens
aggggcaagaggatggttagctgcagcaaagagagagccaaagagaagtgggattgagagcacaggggacagctggagacaaaatataaacgccgggcaggggaacagccaagatagtgcaggaaggatggggaatcacagaaacttctcaggaacccagtgaaatgagctgcaccaggaactttaagagagagttttcagctgggagaagaggaaggcaagatatcagaacaagaatctgaacctgtgatgttaagaaatcagtaaatattaaaaagaagatggatgcaagaaggatgaagaaagaaggactcacagaaaacactggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatt

SEQ ID NO: 27598 - DNA, 3726 bp, Homo sapiens
atgcggaccctagaggcaaccagcgggctggatccgcacagcggccctggggaatggatcgtatccccgggagaggtcagcacggcccctcccgtgggtgtcacagagaccgataccggtcccgctccccgggaaggagtgggtctgggtccagtccgcaggaccccctcgcggatgctgacgcagaatggagttgaggtgggggcagcgctggaccctagggcccctgcctgcctcctggggagcccggtgacccaggcagccctgacgctcagcctgtgcaacccgaagctgcttctgcccagtcccagccgcggcccctttaagagggggtggtgcttcagcctggcgccagggacgctgccagcatgcaggccccgacggaagccgagactgcgcttcgtgcgaggcccgggcagcatcggcggcgtggtcagagcgagtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtggtgaaggcattgattgtcctgaccccacagtttctgtcccatgacaaggaccagctgactaaggagctgcagcagcatgtaaagtcagtgacagccccatgaaacctcctcgacactccgaagtccagatcgcaggccccacctggaatgctctccttgcagcctgttcgaagactcatgagaccgtgctgcacactggacttcaaccatgagcttcaccgtctgtctcttccttcactaccttcgctctgcactaggccataagctctgtaggagaaggaactcatcacagtgcctgccccagacaggttgttcataagcacgtattgaaatatagaattcccaggcacctccaacagagagactggaccttgtgagacccaacaagaagccagtatttcagaactgatgaaaaatagcaaggatctagattagggggtatagtgggaatgaaatgggggactgggtgatgccccatatttgtcaacgactcatagtctttctccagagatgtcttcctcccctgtgttctttgtctcatcagctgccaccagcactcactccagccactaaagccagaaagttgaaagacctctgccctcatccggcccagcccccatccagccaaagacctgtcatttcaacctcacgcccaccccgctttccactcccactgctcctgccttagttcagaccaccaccgtcgctctcctacccagttcaagccaagctgacctggccagtggccttcaggccttcccttctccatcctgccatgtccatcctccacaggcagaacaggaagctgtcatgtaaaagtgcaggtctgctttggtccttctcctaaacccttcagtggcttcccggttccctttgggtcctggtacagattccttagcatggccagggaggacagccctccatgatcctcccctccctgagatgttcctcctgccccagcaccctgtgtttgagcccaagcccgccctgtggtgtcacgggaggcccagctcctctgcctggggtgccttgcctggcctaggaactgggaaaacttacctgcttccaagactcagctctagcacctcttcctgctgggtgttttccgatgccccccctctcgccacctcatggggaccccacagtcccctgaagagccttctgccccagtgcctcaccccactctttagacctgtttctgtttccatggctgccttgccttcttagaccacgggctcctgcagagcgggaccccatatctcagtcggctttgcattcccagtgcctggccgaaactgaggctggaatggtctcctattccataagctctcaataacccttgaaaaatgactggaatcctggacagcgccaaggcagcaactgggatgggagagtgatctgctgccctctcctggcaatgtgaggaattgtcctaagcacagacaactccctccctgccttgcacaagtgcaggatgggggaaactggaaaaggagctgatggaggattggggaggtggatgctgtctaaggagacaaactgaattgaggggttgctgggactcggccggctcacatgctattcccatgtcatgggcccaggggccaagtcagtgcttccaaaggagggtgcatcctgagagaggctctggctcccccaacaaaaccctaaactcttgaaggacatcttccttctcagtataccctattgctgtgttgttgtaactatcactgtaacttttattcacttcagtgggcgatcactgagtttttcctccattgttgtaaaacatgtgttttgctcttgtgtgtaaaatgactgtgaatttagccactgccttctcctgattttaactcagctttctactgctaggaggttatctctgttctgggtttctcagctttctatcaaaacccaaatactgtcattcctcggtatccgtaggggattggttccaggaacctcccttgaagataccaacattgcaggtgcccaagcccctgatagagaacagcgcagcatttgcagacaacctatgtacacactgcatgcactttcaatcagctctagattacttctgatacctaattcaatgtaaatgctgtgtcagtagttgtctagggaataatgacaagaagaaaattttgtacatgttcagtacgtaggaaaaagaaagagagatcagactgtcactgtgtctatgtagaaagggaagacataagagattccattttgaaaaagacctgtactttaaacagttgctttgctgagatgttgttaatttgtagctttgccccagccactttgccttagccactttgacccaacctggagctcacaaaaatatgtgttgtataaaatcaaggtttaagggatctagggctgtgcaggatatgccttgttaacaaaatgtttacaagcagtatacttggtaaaggtcatcgccattctctagtctcaataaaacaggagcacagtgcactgcggaaagccgcagggacctctgcccttgaaagtggggtattgtccaaggtttctccccatgtgatagtctgaaatatggcctcgtgggatgagaaagacctgactgtgccccagcccgacacccataaagggtctgtgctgaggtggattagtaaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccgctgagatgtttgggtggagagaaacataaatctggcctacatgcacatccgggcatagtaccttcccttgaacttaatcatgacacagattcttttgctcacatgttttttgctgaccttctccttattatcaccctgctgtcctactacattcctttttgctgaaataatgaaaataatagtcaataaaaactgagggaactcaaaggccggtgccagtgcaggtccttggtgtgctgaatactggtcccctggacccactgttgtttc

SEQ ID NO: 27599 - DNA, 3727 bp, Homo sapiens
atgcggaccctagaggcaaccagcgggctggatccgcacagcggccctggggaatggatcgtatccccgggagaggtcagcacggcccctcccgtgggtgtcacagagaccgataccggtcccgctccccgggaaggagtgggtctgggtccagtccgcaggaccccctcgcggatgctgacgcagaatggagttgaggtgggggcagcgctggaccctagggcccctgcctgcctcctggggagcccggtgacccaggcagccctgacgctcagcctgtgcaacccgaagctgcttctgcccagtcccagccgcggcccctttaagagggggtggtgcttcagcctggcgccagggacgctgccagcatgcaggccccgacggaagccgagactgcgcttcgtgcgaggcccgggcagcatcggcggcgtggtcagagcgagtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtggtgaaggcattgattgtcctgaccccacagtttctgtcccatgacaaggaccagctgactaaggagctgcagcagcatgtaaagtcagtgacagccccatgaaacctcctcgacactccgaagtccagatcgcaggccccacctggaatgctctccttgcagcctgttcgaagactcatgagaccgtgctgcacactggacttcaaccatgagcttcacagtctgtctcttccttcactaccttcgctctgcactaggccataagctctgtaggagaaggaactcatcacagtgcctgccccagacaggttgttcataagcacgtattgaaatatagaattcccaggcacctccaacagagagactggagcttgtgagacccaacaagaagccagtatttcagaactgatgaaaaatagcaaggatctagattagggggtatagtgggaatgaaatgggggactgggtgatgccccatatttgtcaacgactccatagtctttctccagagatgtcttcctcccctgtgttctttgtctcatcagctgccaccagcactcactccagccactaaagctagaaagttgaaagacctctgccctcatccggcccagcccccatccagccaaagacctgtcatttcaacctcacgcccaccccgctttccactcccactgctcctgccttagttcagaccaccaccgtcgctctcctacccagttcaagccaagctgacctggccagtggccttcaggccttcccttctccatcctgccatgtccatcctccacaggcagaacaggaagctgtcatgtaaaagtgcaggtctgctttggtccttctcctaaacccttcagcggcttcccggttccctttgggtcctggtacagattccttagcatggccagggaggacagccctccatgatcctcccctccctgagatgttcctcctgccccagcaccctgtgtttgagcccaagcccgccctgtggtgtcacgggaggcccagctcctctgcctggggtgccttgcctggcctaggaactgggaaaacttacctgcttccaagactcagctctagcacctcttcctgctgggtgttttccgatgccccccctctcgccacctcatggggaccccacagtcccctgaagagccttctgccccagtgcctcaccccactctttagacctgtttctgtttccatggctgccttgccttcttagaccacgggctcctgcagagcgggaccccatatctcagtcggctttgcattcccagtgcctggccgaaactgaggctggaatggtctcctattccataagctctcaataacccttgaaaaatgactggaatcctggacagcgccaaggcagcaactgggatgggagagtgatctgctgccctctcctggcaatgtgaggaattgtcctaagcacagacaactccctccctgccttgcacaagtgcaggatgggggaaactggaaaaggagctgatggaggattggggaggtggatgctgtctaaggagacaaactgaattgaggggttgctgggactcggccggctcacatgctattcccatgtcatgggcccaggggccaagtcagtgcttccaaaggagggtgcatcctgagagaggctctggctcccccaacaaaaccctaaactcttgaaggacatcttccttctcagtataccctattgctgtgttgttgtaactatcactgtaacttttattcacttcagtgggcgatcactgagtttttcctccattgttgtaaaacatgtgttttgctcttgtgtgtaaaatgactgtgaatttagccactgccttctcctgattttaactcagctttctactgctaggaggttatctctgttctgggtttctcagctttctatcaaaacccaaatactgtcattcctcggtatccgtaggggattggttccaggaacctcccttgaagataccaacattgcaggtgcccaagcccctgatagagaacagcgcagcatttgcagacaacctatgtacacactgcatgcactttcaatcagctctagattacttctgatacctaattcaatgtaaatgctgtgtcagtagttgtctagggaataatgacaagaagaaaattttgtacatgttcagtacgtaggaaaaagaaagagagatcagactgtcactgtgtctatgtagaaagggaagacataagagattccattttgaaaaagacctgtactttaaacagttgctttgctgagatgttgttaatttgtagctttgccccagccactttgccttagccactttgacccaacctggagctcacaaaaatatgtgttgtataaaatcaaggtttaagggatctagggctgtgcaggatatgccttgttaacaaaatgtttacaagcagtatacttggtaaaggtcatcgccattctctagtctcaataaaacaggagcacagtgcactgcggaaagccgcagggacctctgcccttgaaagtggggtattgtccaaggtttctccccatgtgatagtctgaaatatggcctcgtgggatgagaaagacctgactgtgccccagcccgacacccataaagggtctgtgctgaggtggattagtaaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccgctgagatgtttgggtggagagaaacataaatctggcctacatgcacatccgggcatagtaccttcccttgaacttaatcatgacacagattcttttgctcacatgttttttgctgaccttctccttattatcaccctgctgtcctactacattcctttttgctgaaataatgaaaataatagtcaataaaaactgagggaactcaaaggccggtgccagtgcaggtccttggtgtgctgaatactggtcccctggacccactgttgtttc

SEQ ID NO: 27600 - DNA, 8630 bp, Homo sapiens
taaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatgcagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgaggcccaaaacttatctatgcaaagtgtgagaatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaattgaattccaaaaagagctttcaatgagagttaaagcaaacctctcacttccctatttacaaaccaaacacattgaaaaactttttactgcaaaccagagatgctccatggaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaatcaccaaaaaaaaaaaaaaaaaa

SEQ ID NO: 27601 - DNA, 5687 bp, Homo sapiens
aatcgtccgccgctcccgttaccggggcaaccgcggcgcctcctccgtgtcggccccgatcgtccctccgcgccattttcaaactgctctagcgccggagcccgtgcctggacggaaggagctagtgggggactcgaggcctgagggcaatgcggctggaggcggaggcaacggcggctggagctgccggactttaatttttggaagtgaataaaacttgttttagaagacgagatgactacagctgtagagagaaagtatattaatattaggaaaaggctggatcagctgggataccgccagactctgacagtggagtgtttacctttggtagaaaaacttttcagcgacttagttcatacaactgagagccttcggcaatcaaaattatctgctgtgaaagctgaaaaagaaagtgccaattttgattttgttttggaaccctataaacttgaaaatgcaagattgagtagagaaaataatgaattatacctagagttaatgaaactgagagaacattcagaccaacacgttaaagagttgaaaacttcattgaagaaatgtgcacgtgaaacagctgatctgaaatttctgaataaccaatatgctcataaactcaaactgttggagaaagagagcaaagctaagaatgaaagaattcaacaacttcaagaaaagaatttgcatgctgtagtacaaactccaggtggcaagaaaagaagtattgctttcaggcgccagcgtatgcaaattgatgaaccggttcctccctctgaagtcagttcatatccagttcctcaaccagatgacccttacattgcagacctccttcaagtggctgataacaggattcaagaacttcaacaggaagtccaccagctacaagaaaagttagcaatgatggaaagtggggtgagagactatagcaagcagattgagctaagagaacgagagatagaacgactgtcagttgctttggatggtggtcggtcccctgatgtcctttctctggagtctagaaataaaaccaatgaaaagcttattgctcatttaaatattcaggttgactttcttcagcaagctaataaagacctggagaagcgtatacgagagcttatggaaaccaaggaaacagtgacatctgaagtcgttaatttaagtaacaaaaatgaaaaactctgccaagaattaactgaaatagatcagttagcacagcagttggaaagacataaagaagaagtgcttgagactgctgataaagagcttggggaagcaaagaaagagattaaaagaaagctctctgaaatgcaggatcttgaagaaacaatggcaaaacttcagctggaattgaacttatgccagaaagaaaaggagagactgagtgatgaactccttgtaaaatcagacctagaaactgttgttcatcagcttgaacaagaaaagcaaagacttagcaaaaaagttgaaagttttgcagttacagaacgacaacttactctggaggttgagaggatgagactagaacatggaataaaacgtcgagacaggtcaccttctcgtttagatacatttctgaaaggtatagaagaagaacgagattattataagaaagagctagagagactccaacatataatacagcgaagatcttgctctacaagttatagcgcacgtgaaaaaagttcaatatttagaacaccagaaaagggtgattacaattcagaaattcatcagatcacaagagaaagagatgaacttcagcgtatgctagaaagatttgaaaaatatatggaagatatacagtccaatgttaaattattgacagcagaaagagataaactaagtgtcttatataatgaagctcaggaagaattatctgccctaagaaaggaatccacccaaaccacagcaccccataatattgttagtcttatggaaaaggaaaaagaacttgcgttatctgacttaagaagaattatggcagaaaaggaagctttaagagaaaaattagagcatattgaagaagtgagtctttttggaaaatcagaattagagaaaactattgaacatttgacatgtgttaatcatcagcttgaaagcgaaaaatatgaattaaagtctaaagtgttaataatgaaagaaacaatagagtcgttagagaacaaattaaaagtccaagctcaaaaatttagccatgtggctggtgactcatctcatcagaaaacagaggtgaactcacttaggatagtgaatgagcagctacagcggtcagttgatgactatcagcaccgactttccataaaaagaggtgaacttgaatcagcccaagcacaaattaaaatactggaggaaaagatagatgaactaaaccttaagatgacttcacaggatgaggaggctcatgtaatgaaaaagaccattggtgttattgataaagaaaaagactttctccaggagactgtagatgagaagacagaaaagattgcaaatttgcaagaaaacctagctaataaagaaaaagctgttgctcaaatgaagataatgatctcagagtgtgaatcatctgtgaaccagctgaaagaaacattggttaatcgagatcgtgagataaacagcctccggcgccagcttgatgcagctcacaaagaactcgatgaagtaggaagatctagagaaatcgcttttaaggaaaacagaagactgcaagatgacctggctacaatggcaagagaaaatcaagaaatctcattggaattggaagcagcagtgcaagaaaaagaagaaatgaagagcagagttcataaatacataacagaggtgtcacgatgggagagcttaatggctgccaaggaaaaagaaaatcaagatttgttagatagatttcagatgcttcataaccgtgctgaagactgggaggtcaaagcccatcaagctgagggagaaagcagctcagttcgactggaacttctttctattgacactgagaggagacatcttcgagaaagagtggagctattagaaaaagaaattcaagagcacataaatgcccatcatgcttatgaatctcagatctcatcaatggcaaaagccatgtctcgattagaagaagagctgagacatcaagaagatgagaaagcaacagtattaaatgacttgtcatctcttagagaactttgcattaaacttgattcaggcaaagatattatgacccagcaattgaattcgaaaaaccttgagtttgagagggttgtggtggaattagaaaatgtaaagtcagagtcagacctactgaaaaaacaactttcaaatgagagacatacagttaaaaacctcgaatcattgttggctacaaacagagataaagaatttcattctcacttaacctcccacgagaaggatacagaaatccagctacttaaggagaagttaaccctttctgaaagcaaattaactagtcaaagccgggaaaacaccatgcttcgagctaaagtggcacagttacaaacagattatgatgctctgaaaaggcagatctcaactgaaagatacgaacgagaacgagcaatccaagagatgcgtcgacatggtcttgctacaccaccccttagttccactctgaggtctccttcacattctcctgaacatagaaatgtgtaattatcagaaagaataatggctttcaatgagttcctatgtggatttttaaaagaacagaacagtaatgaaatatttgaagtacttgttgctgaaaatcatgaacatggacacaaattctacctctgtcaacttttatttaaatcagtgaatatgttaaaaagtttggtttaaaagaactatatctatatgtatattttcatatatatgacagaacaagaatatgtattaatagtgcctaatgtatctatatttttattattcatgaattaaattactaaaagtatgtttatactgtgaattaatataatgtattcacattattctttaataatctgtttattaataagccatgatatgtgtatgtaaatattcttacagtacttgtttttagttgtcatgcctatgtttagaccatatcttaatgtattcacaaagaattatcaactttgatgctatgctgtcatgcttaactttttcttcttaaaattattcatagatctactgtctgttgtcaaggggaatatattcaggtctagtcttcttataatagcagaggtcttggtaaaataactaccatatataacgtgttattgccatctagaagaactatgatgagaaagatacatttatatattatgtaaaatgttaactatcatcatatggactctatgtaacacaaattcaaaagcaaactaaaagctatatgcagagttttgtataaaacaatagaacagaaatttgggacatttttctaggaaataaaattcctcggtgtattaatctaaggtttcaaagtataaaagtatatggggtaggccgggtgcagtggctcacgcctgtaatcccagcactttgggaggccgaggcgagtggatttcctaaggtcaggagtttgagaccagcctgagcaatgtggtgaaaccccatctctactaaaaatacaaaaattatctgggcttggtggcgggcacctgtaatcccagccacttgggaggctgaggcaggagaattgcttgaacccgggaggtggaggctgcggtgagccaagatcatgccattgcactccagcctgggtgacagagtaacactctgtctcagaaaaaaaaaaaaagaaaaatatatggggtaaatacagtaaaacgttttgttaaattccaatatacattcagtgataccactctttttcttctaagcctgtgtgttataatttaccagttccccaaaatgccatttttaacgccgaactgtgtaatatacatggaaaacagctttttacaattaattttcaaagttgtaattttaaagaatttgggtgtatacctatgttaatgaaacaacagaagtacaaaaaagaatatcagatacaaaaatcaatcgtgaagaaaatctgttcttaatatatttcattatgattgaaaaacataaaaactaacataggaaagtgaatgatcagttacttatgatatattttgtttcctcttgtggtttaataaagtgaagtgtgtgtgtgtgtgtgtgtgtgtatacctgggggtgggcagtgctctttttctaaaactaatatggcttatatatctgaattatgccctttttagtgtgtattaggatgtgggctggtttgcttttctaccacctttgtaattttatgtatcccatctcctttgtgtgaattcatatattatagcaaaatacaagagacatgggactgtttgcaataccatatggaaatcttttaataaatatatgtaaataaaataaaaaatatttgtctccaccttttccccaaaagcaacagcaagacatattttgttagatattttatttttaatgttttctataatttaaaaatgtatagcctgccaaatgttgttttcataaccatgatattgttttgaaaaaattttatcttaaaatactgaatgttctgaccttttatagatgtttttgattttgttttaaataattttaaattatggagcttgacctagatttgccaataaactttctagcctaaaaaaaaaaaaaaaaaa

SEQ ID NO: 27602 - DNA, 2678 bp, Homo sapiens
gtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtataatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaaaaaaaaaaaaaaaaa

SEQ ID NO: 27603 - DNA, 2884 bp, Homo sapiens
gcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattaccacttttgtggtttattcgtggtccttgggatatttgagactgtccagaaatttatggttggaccttgaagcaagagtaggaaaaaactaataccagaaaagcataaatattaataacctcatatgaaagtacatgaatcatttagaaatatttatcactgtgatttgttgtaaaaatgaattgggtattttagaaaaactttattatacctctttgttatgatactgataaattgtgatcttgcagtcgaaaaaaaaaaaaaaaa

SEQ ID NO: 27604 - DNA, 2065 bp, Homo sapiens
gttgagaggccccaagacccagttcctttacagaatcaaccctggggtggctttaggactgggctctttggagctcatccttggacccacagtggagtgctggtccgtgctgatgtcttcagataccaatcaatgggcatttggctccttgcttccactgacctcttgagtactttcaacgatcggtgtcaggagtgccccagctgctgtttctagagcatctctgcaacccacggtggcctctcctctctctgcgggccatggacagcacagtcccttcagccctggagctgccccagcggctggcactgaacccaagggagagcccgaggagtccagaagaggaggagccccacctgctgagcagcttggctgcagtccagaccctggccagtgtcatccggccttgctatggcccccacggccggcagaagttcctggtgaccatgaaaggagaaacagtgtgcacggggtgtgccactgccatcctcagggccctggagctggagcacccagcagcatggctcctccgggaagcaggacaaacccaggcagagaatagtggggacggcacagccttcgtggttctgctgacggaagccttgctggaacaggcagagcagctgctgaaggctggcctgcctcgcccgcagctccgggaggcctacgccacggccactgcagaggtcctggccacactgccctccctggccatccaatctctggggcctttggaagatccatcctgggccctccattctgtgatgaatacccacaccctgtcccccatggaccacttgaccaagctggtggcccacgcctgctgggctatcaaggaactagacggcagcttcaagcctgagcgtgttggggtgtgcgcgctgcccggggggacactggaggattcctgcctcctcccggggttagcaatatctgggaagctctgtgggcaaatggccacagtgttaagtggtgccagggtggctctctttgcttgcccctttggtcctgcccatccaaatgcaccagcaacggcccgtctttctagtcctgctgatctagctcaatttagtaaaggaagcgatcaattactagaaaagcaagtaggccagctagcagctgcaggaattaatgtggcagtggtgttgggggaggtcgacgaggagaccctcacactggcggacaagtatggcatcgtggtgattcaagctaggtcttggatggagatcatttacctgagtgaggtgttggacacacctctgctgcctcgtctgctccctccccagaggccaggcaagtgccagagggtttacaggcaggagctgggagatggtttggctgtggtatttgaatgggaatgtacaggcacacctgccctcactgtggttctcaggggagccaccacccaggggctgcggagtgcagagcaggccgtctaccacggcattgatgcctatttccagctatgtcaagatcccagactgattccaggagctggggccacagaaatggctttggcaaaaatgctttctgataaaggaagcagattggaagggcccagtgggcctgcattcctagcatttgcctgggccctgaagtatcttcctaaaactttggcagagaatgcaggcttagctgtctcagacgtgatggcagaaatgagtggagtgcaccaaggtgggaacctcctaatgggtgtgggaactgaagggataataaatgtggcccaggaaggggtgtgggacaccctaatagtcaaagcccaaggatttcgagcagtggctgaggtggtgctacagctcgtgactgtagatgaaatcgtagtggccaagaaaagtcccacacatcaggagatctggaatcctgactctaagaagacaaagaaacacccacctcctgtggaaacaaaaaaaatccttggattgaataactagtgataccctcaataaaacagggattgccaagaagggaacaatcaccccaaaaatgaatgtttgcctttattccgtgtttggtacttgattcactttctttaaataaaaacatgaaggaaaaaaaaaaaaaa

SEQ ID NO: 27605 - DNA, 1161 bp, Homo sapiens
ggggggcggtgccgttgggaccacggcggccagagcggcaggatggcttccggcttcaagaagcccagcgctgcctccaccggccaaaagagaaaggtggcacctaagcccgagctcactgaggatcagaagcaagaagttcgggaagcatttgacctcttcgacgtggacggaagtgggaccatcgacgcgaaggagctgaaggtggccatgagagcgctgggcttcgaacccaggaaggaagagatgaagaaaatgatctccgaggtggacagggaaggcacggggaagatcagcttcaatgacttcctggccgtgatgacgcagaagatgtccgagaaggacaccaaagaagaaatcctgaaggccttcaggctctttgatgacgatgagaccgggaagatctcgttcaaaaacctgaagcgtgtggccaacgagctgggggagaacctcacggatgaggagctgcaggagatgatcgacgaagctgatcgggatggggacggcgaagtgaacgaggaggagttccttcggatcatgaagaagaccagcctttactgaagtcggttcagaagctaaagtgactctctgggttgcctgcttccattttgtgaaaccttagaggacagcggctgcctgtcccttcttcaccccctcacccccataatttgtctagatctatttccatatctctagttcaataatagaatttgaaagatgcttgtaatgtgagttttgggttttaattctcaagagccaacctggagcacatgaggttaaacaaagggccctgaagtttgagtgcgccctccatttgccctgtgctgaacttgctgttcatctgttgatctggaggcaggacagcttctgggacacacaaaaatgtggttccctttgtcacttctttggtggtcttaaattatcttgcttcatatatcattccttaaattccagtcattgttccagcataatgagatggaatctgccagtagatttgcctagcctgtccacttagctgaataccagtttgaaggaaaacagggtggccacttacaaacttacggagctcaggacagatattcttataaagaatagacttgcttgggtggtagtacgttgtgcaattttgactattcactggctttatacctgcaaatgccc

SEQ ID NO: 27606 - DNA, 7147 bp, Homo sapiens
tgctggagagacagggagaggggcgaaccggccccccacagccactgcaggagttccaccatcttcctctgaagacgtagccatcttgctccatgaagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcgcagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaagaactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtacgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcacaatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaaaaaa

SEQ ID NO: 27607 - DNA, 745 bp, Homo sapiens
ctgctggcagacagaaaggtgtggttggcatggggcaatgcttgaggtatcagatgcactgggaggacctggaagagtaccaggccctgaccttcctgaccagaaatgaaattctgtgcatccatgacaccttcctgaagctctgccctcctgggaagtactacaaggaggcaacgctcaccatggaccaggtcagctccctgccagctctgcgggtcaaccctttcagagaccgtatctgcagagtgttctcccacaaaggcatgttctcctttgaggatgtgctgggcatggcatctgtgttcagcgagcaggcctgcccaagcctgaagattgagtatgcctttcgcatctatgattttaatgagaatggcttcattgatgaggaggatctgcagaggatcatcctgcgactgctgaacagtgatgacatgtctgaggacctcctgatggacctcacgaaccacgtcctgagtgagtcggatctggacaatgacaacatgctgtccttctcagagtttgaacatgcaatggccaagtctccagatttcatgaactcctttcggattcacttctggggatgctgatgtagcggcaaacacctgacatggcagcctcgagggagaccacaggaatcgaaccccctccagcactggagggagctggtttgaagtatgactttgtactgggcccacactcacctctagaatattgtttattagataaaagaaaaagcttttcctta

SEQ ID NO: 27608 - DNA, 3493 bp, Homo sapiens
ctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagctctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctattagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcagtaatctagcttaaggctgtaactcttctatcggggctaattgtatgaataggtgtcagtatgttgaagattactttcttttgtgactttcttctacctcatgccactgtttaaaagtaaaatgtattttaatgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccgtccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaaaaaaaaaaaaaaaaaaaaaaaaaa

SEQ ID NO: 27609 - DNA, 3029 bp, Homo sapiens
agtagagtgtgtctgggtcagctgagtgactacatcaaagctcccagccttgaaaaacacatgctgttcccaggcctcaagatattgaaacattaattagataatttaaagtagcgttttcttctacaatgtctgaagaagtgaactatgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacgttggggatgatgtttttgcagatatctaatgacattaactcagattcagagaaattgagtcaacttcagaaaaccatccaacagcagcaggataacttatcccagcaactgggcaactccaacaacttgtccatggaggaggaatttctcaagtcacagatctccagtctactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttgtacgtctctaactattgagggtaaacacaagctttccatggaatcctgggaaaattaataatgattgtgagaattataaatacagacataaaaagaggagtacaacatactgagaaaagagctccagtaacaaatattgaaaggaggtatagttcatttcatctctgtgacaaatttatagcaaggcactgaattttatcttttggtagaaatgtgtttatttaacacacacacacacctaatactacattcaaagtattttataaatactaacccttgaagaaagcagttatattcccattttataggtagaaatattataatagagagattaagtaacttgcctgaggtcactcagctcataaattgcactttagggattgtgcactcagtcactcagctattctgactctccagcacctacaatccaaaagggtgctgctggtcataagaacacatatcaacacatttatttatactaaataactgtcaaccattttctaacaaaaagtaagactgaattgactgattagttcaacaattagtgtcatgttgaggacttgccaattacaatatacggcaagtgtcttttatgaattaaaatgaactaaaccttccacttcagggtttggatgaaactatttaaaggacaaatagaatatataacacttggaaaatttcaatttttttaactatttaaagttatgaaaaaatagacgtcaacaaaaatgtgtaaggggatattaggtttgctaaattctttcacagactataaaacaaaaaattttgaggaacacctctcatcataactacatttaaatgaaacaactgtattaatattttaaatataatagtatttttctattagataaaatttaagatctttggcatcttaatggatttttaaactttttattgatacataagagatgtatatgttttggggtatatgtgataatttgatacattcagatagtgtgtaaagatcaaataagtggaattgggatatcgatcactttaaatatttatcttttctttatgctaggagcattcaaattattattttctcattattgtgaaatgtacagtagattattgttaattgtattcaccctaataatctatgaaacactaggtcttacttcttctatctaacagaatatttgtattcataatggctttttatctaccttcctcccccaacaaatcattatccacccccctccctcctgtttcactctttaaagcatgttgtcaacgttttcttaaactgaataataatcactcatcttctgtcaaagatgccatgcttcagctgtgactcagcagttccttaaatcacaaacaatggtaggtctattattttctccctggatacactttatcttcatccatttcccaatgttttgtcatggctatttctactcaaacactaatcccccattttctaatcaccattattaatcatatcaagtcaattagtttggtttcacactaataataatgacaaaaagcacatgcagagtaatacacaaacaaaaaaagtgacagttacttttttgtgacaagagcaatattgggtatgaactgattaatattaatctgaggtgttgctactagactgagggtttccaggagtagtactatgacatcatgtaaacacattcagttttcatgttggaatctaagatgtgtcccttctcccaaagggattttaatcattcttggcctctctactcactcttaatcaaagtgtggaggaggtggcccccacagcagggtttggaacctacagaccctggcccctgagacatgcagctgtcagacaagccagcatgtcaaacacaggttagagagactgagcttccagattgcatagccatttccttgactactgagtaaaggccaaggctaagatttagtaagcctagccctgaagcaagcaaagaatatggcagtgtaatgcaggtcatttagaaaaaaacaatgttgggcacaaagaaaatttagatctgacaagtataattttctaaagacattatttcaggattaacatcaatttcttagcagaggaaatgaatactattgtcagaaccatatctatatagtcaatcatttcctcttttaacgtctgtcttgttctctttttacccaccacatatgtataactatgtgaaaaattatatttgtgcataataaaatgtgataactttttacaac

SEQ ID NO: 27610 - DNA, 2710 bp, Homo sapiens
cgccggcgggactggtctgaagagacgcggggacaaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagaggatgtttggcattgtaaaaatcagcatgccagacctgaactttaatcagtctgcacatcctgtttctaatatctagcaacattatattctttcagacatttattttagtccttcatttccgaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctgaaaaaaaa

SEQ ID NO: 27611 - DNA, 3131 bp, Homo sapiens
gtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaaaaaaaaaaaaaaaaa

SEQ ID NO: 27612 - DNA, 2681 bp, Homo sapiens
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaaggtgacctctccatcccagcatgtaccttgtttgattcttctcctgctgtctgctttgctgttcagcttgtgtgattccatttgacacttaatctttctccatcctgtgctccaaaaacatactgatgcctgatttaaggaatcaggtcttcagagaggaatgaagaaggctgtactgccagatataagggcactgcctggcatagaagaaaaaattattatcaccagatattctagctacagtttttcaaccacctgacaccaatttatggaaaaataaaggatttttgaaaaaaaaaaaaaaaa

SEQ ID NO: 27613 - DNA, 2607 bp, Homo sapiens
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggc

SEQ ID NO: 27614 - DNA, 946 bp, Homo sapiens
cggcgcgtgtcacgtggtgtgcgtgtcgaaggtcacggcgcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaaga

SEQ ID NO: 27615 - DNA, 4095 bp, Homo sapiens
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttacttaaaa

SEQ ID NO: 27616 - DNA, 4184 bp, Homo sapiens
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagaaatgatgacagagctaagttcacagttgaggaccacacaatgcaaagagattttagatggctgtgggtctacgaaataggctatgcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttacttaaaa

SEQ ID NO: 27617 - DNA, 1969 bp, Homo sapiens
cccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgcagccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaacgccctcaccatttttatttttatttttattttttttgagacagagtttcgctcctgtcacccaggctggagtacaatgatgcgatctcagctcactgcaacctctgcctcccgggttcaagtgattctcctgcctcagcctcccgagtagctgggattacaggcatgcaccaccacgcccagcttattttgtatttttagtagagacggggtttctccgtgttggtcaggctggtctcaaactcctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacatttaaaagatttcagaaggttcctggaaattccaatgtccacccatgagtcctcagctgagactccctgctccgctgccctctttgtctaagagctgtggcaacagcacctgaatttcagaaacaaaaggccgggcgcggtggctcacacctgtcatcctagcactttgggaggcagaggcaggaggatcgcttgagctcaggagttcgagactagccttagcaacacagtgagacacaattgctacaaaaagattttaaaattagtttgacggggtggcgtgtgcctatggtcccagctactcaggaggctgaggcaggagaattgcttcaatccaggaggtggaggttgcagtgagccgagatggcgccactgcactccagcctgggccacagaccctgtctcaaaaaaaaaaaaaaaaaaaaaaaaa

SEQ ID NO: 27618 - DNA, 1609 bp, Homo sapiens
aaaaggggtcaagaaggcaggaccccgtgaagcacacctttcctaaggattttgacgaatgagaatgaagataaactgtgagttgaaagtgaaagagaaagcataagggatcttaggtgcatctgacaagccttagatgacctccagcaacttcagttctcaccgaattactgcatttcagccttactgagaagcagccagtcatactatcctcaaattttaacccaggatgagttctcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcgttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaaggttttgtggatatattgacatatatccataccatgaatgttatgatcacaaacaccaataatggttggaaatacttttgtcccatctgtggaaggctttttaacacttactctgaattaagacaacattcatgcagctcttctgggaattaagttaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttgaaccaagtaaatgttttcactgtcttaacatctatttctgtagatgtaaatattgttaacataaaagaatccaagttaacaggatcctgactaagatagcaaacatatattggaaggccagacaaagttctaccaagtgtttccagagattctgctacatgtattatctgaaatgttctccatatattcaataaaaaccaatttgaagacaaaaaaaaaaaaaaaa

SEQ ID NO: 27619 - DNA, 3772 bp, Homo sapiens
gggggctttcttgggcttggctgcttggaacacctgcctccaaggaccggcctcggaggggtcgccgggaaagggagggaagaaggaagggcggggccggcccccctgcgcccgccccgcgcctctgcgcgcccctgtccgccccggcccagcccagcccagccccgcgggccggtcacacgcgcagccagccggccgcctcccgcgcccaagcgcgccgctctgctgtgccctgcgcccttgccccgcgccagcttctgcgcccgcagcccgcccggcgcccccggtgaccgtgaccctgccctgggcgcggggcggagcaggcatgtcccgcccggggaccgctaccccagcgctggccctggtgctcctggcagtgaccctggccggggtcggagcccagggcgcagccctcgaggaccctgattattacgggcaggagatctggagccgggagccctactacgcgcgcccggagcccgagctcgagaccttctctccgccgctgcctgcggggcccggggaggagtgggagcggcgcccgcaggagcccaggccgcccaagagggccaccaagcccaagaaagctcccaagagggagaagtcggctccggagccgcctccaccaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtatccctacgacctggtgcggtccccctggaagacgcaggaacacacccccacccccgatgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcggaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtgcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagccttcctgaagggccagaaaatttagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctgggaaaaatgaaaaaaaaaaataaagcaaatggtaagacccttaaaaaaaaaaaaaaaaaaaaaaaaaaaaaaaaaaaaaaaaaaaaaaaa

SEQ ID NO: 27620 - DNA, 1406 bp, Homo sapiens
cggtgagaggggcgcgcagcagcagctcctcaacgccgcaacgcgccggcccaactgcaggaaggtctgtgctctggagccagggtaaatggttataaaattatacaccatggccctcctaaagacactctaggaaaaccatgtcatcctgatcttaaaacacctgcaagaaagagcacagtacttcaccattaataaagtagatatttcatcctgctcagaaaaccaacatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgcaaaaaaaaaaaaaaaaaaaa

SEQ ID NO: 27621 - DNA, 701 bp, Homo sapiens
gggccccttttgtgttgttcttgccaacgcagcagccatcctgctatatagactggctgtgcagccgcaggccccatcacactgaactcgcatcatccgtgtcaacccagccatggggaagatcaccttctatgaggacagggccttccagggccgcagctacgaaaccaccactgactgccccaacctgcagccgtatttcagccgctgcaactccatccgggtggagagcggctgctggatgctctatgagcgtcccaactaccaaggtcaacaatacttgctgcggcgaggggagtaccccgactaccagcaatggatgggcctcagcgactccatccgctcctgttgtctcatcccccaaacagtctcccacaggctgcggctgtacgagagggaagaccacaaaggcctcatgatggagctgagtgaagactgccccagcatccaggaccgcttccacctcagcgagatccgttccctccacgtgctggagggctgctgggtcctctacgagctccccaactaccgggggcggcaatacctgctgaggccccaagagtacaggcggtgccaggactggggggccatggatgctaaggcaggctctttgcggagagtggtggatttgtattaaaatagcttaacactaccaatttcccattttggaacctaataaatatttagtctgcattgctggc

SEQ ID NO: 27622 - DNA, 902 bp, Homo sapiens
ctagagagtatagggcagaaggatggcagatgagtgactccacatccagagctgcctccctttaatccaggatcctgtccttcctgtcctgtaggagtgcctgttgccagtgtggggtgagacaagtttgtcccacagggctgtctgagcagataagattaagggctgggtctgtgctcaattaactcctgtgggcacgggggctgggaagagcaaagtcagcggtgcctacagtcagcaccatgctgggcctgccgtggaagggaggtctgtcctgggcgctgctgctgcttctcttaggctcccagatcctgctgatctatgcctggcatttccacgagcaaagggactgtgatgaacacaatgtcatggctcgttacctccctgccacagtggagtttgctgtccacacattcaaccaacagagcaaggactactatgcctacagactggggcacatcttgaattcctggaaggagcaggtggagtccaagactgtattctcaatggagctactgctggggagaactaggtgtgggaaatttgaagacgacattgacaactgccatttccaagaaagcacagagctgaacaatactttcacctgcttcttcaccatcagcaccaggccctggatgactcagttcagcctcctgaacaagacctgcttggagggattccactgagtgaaacccactcacaggcttgtccatgtgctgctcccacattccgtggacatcagcactactctcctgaggactcttcagtggctgagcagctttggacttgtttgttatcctattttgcatgtgtttgagatctcagatcagtgttttagaaaatccacacatcttgagcctaatcatgtagtgtagatcattaaacatcagcattttaagaaa

SEQ ID NO: 27623 - DNA, 1008 bp, Homo sapiens
agtgttcggctggggcaggcacgctgtggctggctgcttcccttccttccatcccctttggaccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgctgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttccca

SEQ ID NO: 27624 - DNA, 1008 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttccca

SEQ ID NO: 27625 - DNA, 1008 bp, Homo sapiens
agtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttccca

SEQ ID NO: 27626 - DNA, 2267 bp, Homo sapiens
atctacggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccgggtgattttcataacttcatgctccatcagtgatcccatgttgtcttttatgatgccatttgatctgatgacgaacctcactgttgaacaaccagtatttgctgcaaacttcattaagggaactattcaggcagctccatatggtggctgggaaggacaagctacttttaaattagtcttcagaaatggaggtgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcacgaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcaggtatgtgatcacaggcttctcgcaggtagttgttccaccctttggaagggcaatcttatgggggaaggtgaaactttacttctgtgcctagattttagaagcagaatcaactcttaaatagctggctaaaggaagaataccattgtggggctaattccccagtaatttggttgacattgggttgcatttttaaacataactttttccacactcgcattcaaggttcctgtcttcccatcctcattcaagaaacatttattatgctccgtttgctaggcactaagatgcgtgctaaaaacgtcatgttgaacacttagttgtttgagaaagctaaattttcaatagtaagagtgttataaattacggtggatccacaaattggagtattatacacctgttgaaaactatgtctagaggtagagaaagccttctttgaggagaccaaaaccaacaaataaaagcatgataaattgactatatcaaaatttaaaacttctctatgacagaagttaaaagataggcaacagaataggaaaaagtgattttcaacatatatattaatttatagtcagaatacgtgaataactacaaatcaattctccccaaaatgacagaaatatgaattgccgaataaccaaggcaatagcatggccagaaaacgtttgaaaagatgttcagcttgactagtgttagggaaatgcaacctgagatgagaaaacatttttatctccaaagatttacaaatattaaaactcttgatatggcactttcacattttaaaatatgcctgcgagaaaacttgcatgtgtgcacaaagatgcatgtgggaagatttcattatattcattgtttctaacagcacaaaattagaaataacctatatgtccattaataggaaatatatgaataggctatggtatgcccatactacgtatgcagaaatttctaagacttgttgataaggagaaaagcaagttgtagggagcatatactatagtgattttcagcctcatcagactgaatgccccattttataacaaatatttatattttataacaaacgtttatatttgtatatttataacaaatattttgtaatgtctccttcacttcaatgaagtttgtagataattgcatatgattccacaccatttcaaccaaaattaataggccataaatgtgatagaggaaataaaaggagtttgtagtaaaaaaaaaaaaaaaa

SEQ ID NO: 27627 - DNA, 991 bp, Homo sapiens
atcctcgtgggccctgaccttctctctgagagccgggcagaggctccggagccatgcaggccgaaggccagggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgagaggaggcgccccgcggggtccgcatggcggtgccgcttctgcgcaggatggaaggtgcccctgcggggccaggaggccggacagccgcctgcttcagttgcacatcacgatgcctttctcgtcgcccatggaagcggagctggtccgcaggatcctgtcccgggatgccgcacctctcccccgaccaggggcggttctgaaggacttcaccgtgtccggcaacctactgtttatgtcagttcgggaccaggacagggaaggcgctgggcggatgagggtggtgggttgggggctgggatccgcctccccggaggggcagaaagctagagatctcagaacacccaaacacaaggtctcagaacagagacctggtacaccaggcccgccgccacccgagggagcccagggagatgggtgcagaggtgtcgcctttaatgtgatgttctctgcccctcacatttagccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacgaaaaaaaaaaaaaaa

SEQ ID NO: 27628 - DNA, 766 bp, Homo sapiens
tcctcgtgggccctgaccttctctctgagagccgggcagaggctccggagccatgcaggccgaaggccagggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgagaggaggcgccccgcggggtccgcatggcggtgccgcttctgcgcaggatggaaggtgcccctgcggggccaggaggccggacagccgcctgcttcagttgcacatcacgatgcctttctcgtcgcccatggaagcggagctggtccgcaggatcctgtcccgggatgccgcacctctcccccgaccaggggcggttctgaaggacttcaccgtgtccggcaacctactgtttatccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacgaaaaaaaaaaaaaaaaaaaa

SEQ ID NO: 27629 - DNA, 3493 bp, Homo sapiens
acgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgcaaaaaaaaaaaaaaaaaaaaaaaaaaaaaaaaaaaaa

SEQ ID NO: 27630 - DNA, 2446 bp, Homo sapiens
gcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattct

SEQ ID NO: 27631 - DNA, 3511 bp, Homo sapiens
aaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggaggtgggggttctggagtccatatgggaaatcctacaccgctatctcccctataactcacatgctgccagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggactcagatctccactcctctccaggagctagcctgtgcccttctgaagtgtaaaggccctattccctgccttcattacagtttgctctgagaaaattagtgaattaatctttgggaatgatacaagaagatcaagtaccttggtttagggagatgtagaagaggatagtcagagttcaggcagaactgtttgatagttaagagagagtagttctacaggggtgagggatggaaggacttttttggcaatgatggaaatgagatgtctgcaggaagatgggatttacaaagaaataggaaatgtttatcattgaccatacaaagctggcttatcttacttgtagaagagtgtttggcagctgaaacccaagggaaagaaaggaagtgcgtcattataggcaattcaggctagatattatactaggtacttcatataccctctttttttttttttgcccccaaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtccttcgaaactttggaaagtttaatagctcaaagccacactaggtagtaaccactagagccagaatgcaaattcaagtctgcccaactccaaagtccatgttctctcaatataaagggaccatctcaatgtctaatctcatgttaacatttgtagccactgctctcagcaagtatttgggatgtggctttgtcctaggatccctgcacaataggaaattgtggtcctattgtatagtttgcagttattgtctctggaagggagtttgcagagttctcctgtggcgaagaggaggcaaggaaggctaagtgtcagttaagcaatagctattggggctacttctttgttaatcccataccccagatttctctcctgaccttttggggcaaagaggtgggtatttactaacttgaaggaaaactagagtggggaaaaggccggcaaattagtgacactttggcgagggagaaaaaggaggcagtttgccacttggagaagatgaggaagacagggttgcaagacggtgactccaaaagagggagctcgacaggggtaatgtaaacagagatgctaactaagtcagaaaactctcctggtgaccaaaagagaaccactattgggggtaatggctagatttggtctcctttaacttaaggaggggagatttgagaatgacagacagttgaacttcctggcagcagcaagcaaaaaacaaatcaggaagagtttagtgtgtcttctggcaggggacaccagggcccagcacaggagaaggtggcccctgtgagatactggtgggctatataggcgttttctgaggggctttgggaggcatgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgaaaaacaaacctaaacatcgaactttccttagcttcttcagtggcttccaactgcttttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactccaaaaaaaaaaaaaaaa

SEQ ID NO: 27632 - DNA, 2119 bp, Homo sapiens
gggatgtctctcccaagattccaaagagtaaactttgggccatatgataattacattccagtcagtgaattaagcaaaaaatcatggaatcagcaacactttgccctgttatttcccaaaccacaacggccaggaaccaaaaggagatcaaaaccttctcaaatacgggacaacacggtttctataattgatgaagaacaattaagaggagatcgtagacaaccattatggatgtaccgttctttaatgagaatttctgagagaccatctgtttatttagctgccaggaggcagcctctcaaaccaactcgtactgtcgaggtggattctaaagcagcagaaattggtaagaaaggtgaagacaagacaacacagaaggacacaacagattcggaatcagaattaaaacaaggaaaaaaagattcaaagaaaggcaaggatatagagaaaggaaaagaagaaaagctagatgcaaagaaagatagcaaaaaaggtaaaaaggatgcagagaagggcaaagactcagcaacagaatctgaagatgaaaaaggaggtgcaaagaaagataacaaaaaagataaaaaggattcaaacaaaggcaaagactcggcaacagaatctgaaggtgaaaaaggaggtacagagaaagatagcaaaaaaggtaaaaaggattcaaagaagggcaaggattcagccatagaattacaagctgtaaaagcagatgaaaagaaggatgaggatggaaaaaaagatgcaaacaaaggtgatgaatcgaaggatgccaagaaagatgcaaaggagattaaaaaaggtaagaaagataagaagaagcccagtagtacagacagtgactcaaaggatgatgtcaagaaagagtctaagaaggacgccacgaaagatgccaagaaagttgccaagaaagatactgagaaagaatctgctgattcaaagaaggatgcaaagaaaaatgctaagaaggatgcaaagaaggatgcaaagaagaatgcaaagaaggatgaaaagaaggatgcaaagaagaagggcaagtaggccttggataagaatttgaaccgaaagaataattcaaaagcatatttgatgaaacaatagtggtagtctgcagctgaatttgtgagaaaacaagaggcctcaaagaattaaataatttttaaaaggtggtaaagaaggatacaaaggagaactcagcagagatttataaaaatatataagaaagatgttaagaaaaattaaggggggatccattgaaagacttgaagaatacatatacttatattcggggatatgaaggattcaatgaatgatctctagaaagatttaaagaagaatattcagataaggatgttgaagataatgacactaaatctatggacacacacacacacacacacacacacacacacacacacacacacacacacacacagtttaatgaaggcttaaagaatccaaggagacagatgttgtatctatagatttaaaataatctcaagctgcatccacagatacaaaaaaatataggagccatgaaatgaagttaaacaccttgtagaaagcctactttcaagtaaatatagcattcctttggcaaaaagaaaaaaaaagtaaaagaaaagaaaaaaaatgtattaccacccgatgagcctacatctttctttctgaagtttaaacaaccacagtcatgtttatggttgttggatgtgccacttccaatccaaaagaagcacacttgtctcgctctgttgccctggctggagttcagtgacatgatctcaggcttactacagcctccaccttcaggttcaagtgattctcctgcctcagcctctctggtagctgggattacagggaaggaaaatagctggcatttcttgctggagaaagttatcacaagtggaaaggttaccctagaaacaaaagatgactaccgtgaggatggattggacattacaccacactggaaaagtgaaacatctcattcagttggtgatcttcctgtcatgaaagttgcttgacagctctaattacgaattgaacacattaaacacctggtgaaattatcaattaaaaacatctagtcaccataaaaaaaaaaaaaaaa

SEQ ID NO: 27633 - DNA, 3381 bp, Homo sapiens
cgcgattctcagggattgatccgcctcttcaggtaagttatcttccggccccgtaccactgtgccacaggcgcagcccgcttcctcaggtgccctatcccgcgcagaagaccacggcttcacagagtgttatttaagggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgagaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgacacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataaattacatatttatttacctgataaatatgtatctagttctacaaggtcacatttatgtggaagtccaaagtcaagtccttaggggataattttgttttgggctcagttgttccctgcttccttttttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgagcctcgtgagtccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaat

SEQ ID NO: 27634 - DNA, 1635 bp, Homo sapiens
gccttttttgcagtctcaggacgggcgctttggagccggccccaggcagcgtgtgtcggtcgcctagtctggagaactagtcctcgactcacgtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaaaaaaaaaaaaaaaaaaaaaaaaaaaaaaaaaaaaaaaaaaaaaaaaaaaaa

SEQ ID NO: 27635 - DNA, 1650 bp, Homo sapiens
gccttttttgcagtctcaggacgggcgctttggagccggccccaggcagcgtgtgtcggtcgcctagtctggagaactagtcctcgactcacggtgagggaatggaccgacacgggtattgtaccgctgagggaaaggagcgggactccggacctccaggagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttct

SEQ ID NO: 27636 - DNA, 3056 bp, Homo sapiens
attggctgaggccgataccacgcgccccgatacccggcgcaggagccacctccctgagccccgcggaccacgcctcagtccgcctgcgctcctcagcctgacggtccgcctttcggggctcctcagccttgtcacccgctcttggttttccttttctcttcatctttggctcctttgaccactcgaagccgcgcagcgggttccagcggacctcacagcagccccagaagtggtgcgccaagcacagcctctgctcctcctggagccggtcgggaactgctgcctgccgccatcatgtctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcaggcatatcctacttacccaaattcaccagttcaggtcatcactggatatcagttgcctgtatataattatcagatgccaccacagtggcctgttggggagcaaaggagctatgttgtacctccggcttattcagctgttaactaccactgtaatgaagttgatccaggagctgaagttgtgccaaatgaatgttcagttcatgaagctactccaccctctggaaatggcccacaaaagaaatctgtggaccgaagcatacaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctataccacagtctttcgtttccagcctttgtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaactttttttcttcaaaaaaaaaa

SEQ ID NO: 27637 - DNA, 3923 bp, Homo sapiens
ctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggggaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttgggaggccgaggcaggctgatcacgaggtcagaagatcaagaccatcctggccaacatggtgaaaccttgtctactaaaaatacaaaaaattagctgggcatggcggcatgcgcctgtagtcccagctactccctccagaggctgagaattgcttgaacctgggaagtgcaggttgcagtgagccaagattgtgccactgtattccagactgggtgacagagtgagactccatctcaaaaaaaaaaaagttgactctaccccctaatttggtaggagatgaaggagaaaaggatggcattgaattatagatacagttttgggatatatacaaggattgccttgatctggcacttactgatacaagcatttggagaagagaaaattcaaatataagaaatttcaatttgaatctgtggatataaggcatttgcctttgagtatgttcttgtaggagtaagactaccaccagtgacattcaattggttctattgcatagtacatgaatctattgtcactaaaaattaggttactaatcttaatttttttgaaatatatgattctcagtacaggactaattcatatgcttttcctgcatacattattttgatcatttggataacatcaatgaacactggctttttaacacctttgtttttcataccagtacctgaagtaggctcaataaaagagtctttacagtgaaaaaaaaaaaaaaaa

SEQ ID NO: 27638 - DNA, 4608 bp, Homo sapiens
atggagaatagtcttagatgtgtttgggtacccaagctggcttttgtactcttcggagcttccttgctcagcgcgcatcttcaagtaaccggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgcaatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggactttacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcccatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttagctgct

SEQ ID NO: 27639 - DNA, 1719 bp, Homo sapiens
agaagcgacgctccgcccaccccgacgcggtctctatggtaaccggtcaccgcttctatggagtggcgtttactaccaattgcaaataagaaaattccagattccattccaagatggccaaataggaacagctccagcctgcagctcccagcgtgattaatgtagaagatgggtgatttctgcatttccaactaagctgaaaatggcaaaaacaggagcagaagatcacagagaagcactatctcagtcttccttatccctcttgactgaagcaatggaagtattacagcaaagtagccctgaaggcactttggatgggaatactgtaaacccaatttacaaatatattttgaatgatttaccaagagagtttatgtcatcccaggcaaaagcagttattaaaactactgatgattatttgcagtctcagtttggccccaacagactcgtgcattcagcagcagtatcagaagggtcaggacttcaagattgctccacacatcaaacagcatcagatcacagccatgatgaaatatcagacctagatagctacaaatcaaacagtaaaaacaattcttgttctatatcagcatccaagagaaacagacctgtcagtgctccagtgggtcaactgagggttgcagagttctcttctttaaaatttcagtcagcccggaattggcagaaattgtctcaaagacacaaacttcaaccaagagtgattaaagtaacagcttacaaaaatggatctagaacagtctttgccagagttactgcaccaaccatcaccttgctgctggaagagtgcacagaaaagctgaatctgaacatggccgcaagacgagtgttcttggcagacggcaaggaagccctcgaacctgaagatataccccatgaagccgatgtttatgtttcaacgggagagccctttttaaatccattcaaaaaaattaaagaccatctgttgttaattaagaaagtaacttggacaatgaatgggttgatgcttcctactgatatcaaaagacggaaaaccaagcctgttctttctattagaatgaagaaacttactgagaggacctcagtccgaattctgttctttaagaatggcatggggcaggatgggcatgagattacagtgggaaaagaaacaatgaaaaaggttttagatacttgtacaataagaatgaatctaaatttaccagccagatatttttatgatttgtatggcagaaaaattgaagatatttcaaaaggaaagcactgactctgagacgtgatacttcatggatgccagaggcattcggattcatgactcgtgcttcacgtatcccagaagtgtgctattatcacattttaatgcatgccttgccctctgtttttgcatccttataaaagcttatgccagctgagattagcctgtgcaaccactaacatgtggaagcattacaagttcactggacttaaaatatttaaagaagctaatcctgttggaggaacttccagtctgtagcaccctagtcacttaacattaggtttttgaacttcttttttctttgtttctatgatgttgtgcatcaaatgattgagatccctaaacttttgtgttggatggttttctgaacttcaacttgggaaaggtcaagttttatgtgaaagttatcttttaatttaaacaaataaatgctgatactcttttgattcgaaaaaaaaaaaaaa

SEQ ID NO: 27640 - DNA, 5711 bp, Homo sapiens
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagttcagacagcctcctctgctaacaccctgtggaagacaaactctgtaagtgtggacggtggaagccggcagcgatcttcgtcagatccgccagctgtccatccaccgctgccccctcttcgcgtgacatctaccaatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatgg

SEQ ID NO: 27641 - DNA, 2589 bp, Homo sapiens
aacgtgctacctcaaggctccacctggccacacagcaggcactgaggctgggagacagcccccagacagatgagtgtccgcgcctctctgagaggtgaatgagcccggacggtccctacctaccaagtcctgaggagcagcggcaccaacgacgcaggcccgccccagcccgccagtgagccgcccatgccctctgctagcccggcccgcccgggcccccgccatgctgatcaccgtgtactgcgtgcggagggacctctccgaggtcaccttctctctccaggtcagccccgactttgagctccgaaacttcaaggtcctctgcgaagcggagtccagagtccccgtcgaagagatccagatcatccacatggagcgactcctcatcgaggaccactgttccctgggctcctacggcctcaaagatggcgatatcgtggttttactgcagaaggacaatgtgggacctcgggctccagggcgtgccccgaaccagcctcgtgtagacttcagtggcattgcggtgcctgggacgtccagctcccgtccacagcaccctggacagcagcagcagcgcacacccgctgcccagcggtcacagggcttggcgtcaggagagaaggtggccggcctgcaaggtctgggcagccccgccctgatccgcagcatgctgctctccaacccccacgatctgtccctgctcaaggaacgcaaccctcccttggcggaagccctgctcagcggaagccttgagaccttttctcaggtgctgatggagcagcaaagggaaaaggccttgagagagcaagagaggcttcgtctctacacagccgacccactggatcgggaagctcaggccaaaatagaagaggaaatccggcagcaaaacattgaagaaaacatgaatatagcgatagaagaggcccccgagagttttggacaagtgacgatgctctacattaactgcaaagtgaatgggcatcctttgaaggcttttgttgactcgggcgcccagatgaccattatgagccaggcttgtgccgagcgatgtaacatcatgaggctggtggaccgacggtgggctggggttgctaaaggagtgggcacacagagaattattggccgtgttcatctagctcagattcaaattgaaggtgatttcttacagtgctctttctccatacttgaggatcaacccatggatatgcttctaggcctagatatgctccggagacatcaatgttccatcgatttgaagaaaaatgtgctggtcatcggcaccactggcacgcagacttattttcttcctgagggagagttgcccttatgctctaggatggtaagtgggcaagatgagtcttcggacaaggaaattacacattcagtcatggattcaggacgaaaagaacattaaagcacgttataaatatgttaccaccttgagggagcctcaggtccccggcaattataagttaagagcttactggcaatgtaatcattaaaaaacatcagtaacaactaaacctggccttgggactacgttctcagatgggtaactaacgtcaatcctgattccttggtcttggtccctcttccatttcccttgtccagagatcactgaaaggcatcctgggaaggctttggaggctccagctgatttccagataatccatgaaaaagaaaaccagcttcttcctttagagacactatcctatcagattacaggtggcttatccaaatcattgctattttgcagaattccctggaaaaatgctatggctgcagaccttacaaggcatccacataaaactatttcacatcagcactaataattctttctactgagagaaatatgcccattttcacaggttttgttttctttgggaagggtattagaaatggtaggtcagttacactatgatgttaactaatacttatacatgtctgtttggggcagcataaagaccaatttcctcatatttacaccttcccttcccctggatcccctgcagtcaccctgcaatccacagctaaagactatttttgccacatttgagaaagtggatttatctccaaggatgctacattaattttctatttctcctgcattcaaagaaactctggctataaaacaaaggcaataaattagattttttaaaaaagaaattatggtacttcttgggagtcaagttgtacagtggtgggaatgagaggtggggacaggcagtggtccaggttctctaatagtcattgcaactagatcatctctctctctttttcaaagtaaaaatctgctttatacattaagctgctgctacatcagtattgtttgaacaaaggttttcactgttaaaataacatttgaaaacttttgaatgagaagatctctaaggcctcattcagaattatccattctgacaatgttagtgtttattacaactgacagtgggtaatggaagatcctagacttaattacaacccatggctaaagcacctgagagaaaagtttcagcttcctgaggccatcagatgcaggggaaatgtttcaggacaataatttatcaaaactggtattaaaacagcggattc

SEQ ID NO: 27642 - DNA, 413 bp, Homo sapiens
agaacccactgcctcctgatgaagtccctactgttcacccttgcagtttttatgctcctggcccaattggtctcaggtaattggtatgtgaaaaagtgtctaaacgacgttggaatttgcaagaagaagtgcaaacctgaagagatgcatgtaaagaatggttgggcaatgtgcggcaaacaaagggactgctgtgttccagctgacagacgtgctaattatcctgttttctgtgtccagacaaagactacaagaatttcaacagtaacagcaacaacagcaacaacaactttgatgatgactactgcttcgatgtcttcgatggctcctacccccgtttctcccactggttgaacattccagcctctgtctcctgctctaggatccccgactcattaaagcaaagaggctta

SEQ ID NO: 27643 - DNA, 439 bp, Homo sapiens
atggggctcttcatgatcattgcaattctgctgttccagaaacccacagtaaccgaacaacttaagaagtgctggaataactatgtacaaggacattgcaggaaaatctgcagagtaaatgaagtgcctgaggcactatgtgaaaatgggagatactgttgcctcaatatcaaggaactggaagcatgtaaaaaaattacaaagccacctcgtccaaagccagcaacacttgcactgactcttcaagactatgttacaataatagaaaatttcccaagcctgaagacacagtctacataaatcaaatacaatttcgttttcacttgcttctcaacctagtctaataaactaaggtgatgagatatacatcttcttccttttggtttcttgatccttaaaatgaccttcgagcatattctaataaagtgcattgccagtt

SEQ ID NO: 27644 - DNA, 672 bp, Homo sapiens
caaccatgaagctcctttttcctatctttgccagcctcatgctacagtaccaggtgaacacagaatttattggcttgagacgctgtttaatgggtttggggagatgcagggatcactgcaatgtggatgaaaaagagatacagaaatgcaagatgaaaaaatgttgtgttggaccaaaagtggttaaattgattaaaaactacctgcaatatggaacaccaaatgtacttaatgaagacgtccaagaaatgctaaaacctgccaagaattctagtgctgtgatacaaagaaaacatattttatctgttctcccccaaatcaaaagcactagcttttttgctaataccaactttgtcatcattccaaatgccacccctatgaactctgccaccatcagcactatgaccccaggacagatcacatacactgctacttctaccaagagtaacaccaaagaaagcagagattctgccactgcctcgccaccaccagcaccacctccaccaaacatactgccaacaccatcactggagctagaggaagcagaagagcagtaatgtggatctttcccttaaaactccaagttcctctctatttttgctatctataaaatgacatagaactgtttcctctgtcatcagtcattcaataaacactgtttgagcacctaca

SEQ ID NO: 27645 - DNA, 3316 bp, Homo sapiens
tttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagcttaggaatcatattttatacttgatagaaaattatcagacagtggtgattgttggtgaaacaggatgtgggaagagcacacagattcctcagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctcccaaaaaaaaaaaaaaaa

SEQ ID NO: 27646 - DNA, 6180 bp, Homo sapiens
gatgagtttttcaaaggtcagagcagattgaacctttgtggtttcattttccctgattttgatttttcttatggggaacctgtgttgctgcattcaaggtgactcgaagaattcttccaaaaagcgtgtgaaaagggagccctactctactaccaaggtgacttcagggagcacattcaatgagaatacaagaagatatgctgtgcacaccaaccagtgtcggagacctcatggctccccggtaaagaagaagatgtacccacaagaagatgacttccatcatacaatcttcagcaaccttgaaagattggacaagcttcagcccactcttgaagcctctgaggagtctctagttcacaaggacagaggagatggagagaggccagtcaacgtgagggtggtgcaggtggcccctctgaggcgtgaatctactccccatggggacaccatccacgacatcacgaacgaggacgccgtccacgacaccaccgacgaggacgccgtccatggcaccgccgacgaggacgccgtccagggcatcgccgacgaggacgccgtccacggcatcgctgactgggacgccatccagggcctcgctgacagggacgccgtccacggcttcgctgatggggacgccgtcaagggcatcgctgacggggacgccacccagggcatcgctgaaggggacgacgtccatggcatcgctgatggtgtcgccgtccagggcatcgctgacgaggatgcagtccagctcattgctgatgaggaccccgtccatggcatcactaaagaggatgccacccagggcttcgcgaacaaggacgctgcccagggcatcgctaatgaggaggccatccacggcatccctaacgaggtcgccatccagggcgtcgctaacgacgacgccgtccagggcggcatcgctaacgaggacgccacccagggcatcgctaacgatgacgccgtccacggcatcactaacgaggacaccgcccagggcatcgccaactgggatgccgtccaggacatcgccaactgggatgccgtccactgcatcgctaacgaagatggattccacggcatcgataacgaggacgctgtccagggcatcgccgactgggacgccgcccagggcatcgccgacggggtcgccgcccagggcatcgctctcgatgatgccgtccacggcattgctaataaggacgccgcccagggcatcgccaactgggatgctgtccaggacatcgctaacgaagatggattccacggcatcgataacgaggacgccgtccagggcatcgccaactgggacgtcgtccagggcatcgccaactgggacaccgtccacagcttcgccgacggggtagccttccacggcatcgccgacggggacgccgtccagggcatcgctctcgatgacgccgtccacggcatcgctaatgaggatgctgcccagggcatcgccaactgggatgctgtccaggacatcgctaacgaagatggattccacggcatcgatatcgaggacgccgcccagggcatcgataacgaggacgccttccaggggcatcgccgacggggtcgccgtccacggcatcgctgacggggttgtcgtccacggcatcgccgactgggacgccgcccagggcatcgccgacggggacgccgtccacggcatcgctgacgaggaagccgcccagggcatcgccaactgggatgctgtccaggacatcaataacgaagatggattccacggcatcgccaacgaggacgccacccagggcatcgccgacggggacgccgcccagggcatcgccgacggggacgccgtccagggcatcgccgactgggacacagtccacggcttcgccaacagggtcgccatccacggcttcgccaacaggggcatcgctaacgaggaggccgtccacggcatccctgaggtcgccgtccagagcatcgctaacgaggacgccgtccagggcatcgctaacgaagatggagtccacggcatcgataacgaggacaccatccagggcctcgccgacgtggacgccgtccacggcctcgccgacggggtcgccgtccacggccttggcgatggggtcgccgtccagggcagcgctaacgaggacgccgtccagggcatcgctaacgaggacgccgtccagggcatcgctaacgacgccgtccagggcatcgctaacgaggacgccatccacggtattgctaacgaggatgccgcccagtgcatcgccaactgggatgccgtccaggacatcgccaactgggatgccgtccagtgcattgctaacgaagatggattccacagcatcgataacaaggacgccgcccagggcatcgccgacggagacgccgcccagggcatcgccgacggggacgccgcccagggcatcgccgacggggacgccgcccagggcatcgccgacggggacgccgcccagggcatcgccgacggggacgccggcatcgctgacgacgccgtccagggcatcgctgatgaggactccgtccagggcatcgctgacgacgccgtccagggcatcgctgatgaggacgccgtccagggcatcgctgacgaggaccatgtccatggcatcactaacgaggatgccacccagggctttgctaacaaggacgccgcccagggcatcactaatgaggacgccgcccagggcatcgctaacgaggaggccatccacggcatccctaacgaggacgccgtccagggcgtcgctaacgaagatggagtccatggcattgataacgaggacgccgtccagggcatcgccgaggacgccatccagggcatcaccaactgggacgccgtccagggcattgccaactgggacgccgtccaggacatcgctaacgaagatggattccacggcatcgataatgaggacgccgtccagtgcatcgccgaggacgccgtccagggcatcgccacctggcacgccgtccagggcatcgccacctggcacgccgtccagggcatcgccaactgggacgccgtccagggcatcgccgacagggacgccgtccatggctttgctgacggggatgccgtccacgacttcgctagcggggacgccgtcaagggcatcgctgacgggaatgccgcccagggcatcgctgatggggacgtcctccacggcatcgctgacggtgtcgccatccagggcatcgctaacaaggacgccacccagggcatcgctaatgaggaggccgtccacagcgtcactaacgcggacgccgcccagggcatcgccaacgaggatgccatccagggcatcgctaaagatgacaccgttcagggcatcgctaacaaagatggagtctacggcattgctgaggacgctgcccagggcatcgctaatgaggacgccgaccagggcatcgctaatgaggacaccacccagggcatcgccaacgaggaagccgcccagggcatcgccgaggacgccatccagggcatcgccaacgaggaggttgcccagggcatcgccaatggggtcgccgcacagggcatcgccaatgaggacgccacccagggcatcgccaactgggacgccgtccacggcttcgccaacggggacgccgtcctcagcttcgccaacggggacgccgcccagggcatcgccaacggggacgccaccaagggcatgggcaacgaggtcaccatccacggcatcgctaacgaggacgccgtccagggcatcgctaacgaggtggccgcccagggcatcgccaacgaggacgccgcccagggaatcgccgaggatgtcgcacagggcatcgccaacgaggacgccgcccagggcatcgccaacaaggaggccgcccagggcatcgccaacgaggacgccgcccagggaatcgctgaggacgtcgcacagggcatcgccaacgaggatgccgcccagggcatcgccaacgaggaggccgcccagggcatcgccaacagggtcgccgcccagggcatcgccaatgacgccacccagggcatcgccgaggacaccgcccagggcttcgccaacgacgacgccgtccagggcatcgctaacgaggacgccgtcctgggcatcgccaacgacgacgccgtccagggcatcgctaatgaagatggagtccacggtatcgataacgaggacaccgcccagggcatcgccaactgggactccgtccagggcctcgccgacggggacgccgtccagggcctcgctgactgggtcgccgtccagggcctcgctgacggggacgccgtcaagggcatcgctgatcgggacgccgtcaagggcatcgctgacggggacgccgcccagggcatccctgacggggacgtcgtccacggcatcgctgacgaggacaccatccagggcatcgctgacgaggacgcagtccagctcatcgctgacgaggaccccgtccatggcatcactaacgaggacgccgcccagggcatcactaactaggacgccgcccagggcatcgctaactaggacgctgcccagggcatcgctaacgaggacgccgcccagggcatcgctaacgaggacaccgtccatggtatccctaaagaggtcaccgtccagggcgtcactaacgaggacgccgtccagggcgtcgctaacgatgacgccgtccagggcgtcgctaacgaggacgccgtccacggcgtcgctaactgggacgccgcccacggcgtcgctaacgaggacgccgcccacggcatcgctaacgaggtcgccgcccacggcttcgctaacgaggacgccctccacggcatcgctaacgaggatgccgtccacggcatcgctaacgagaaaatcaaatgttaaccagcagtgccctgcttcaacaccatcatcggaagtcataagttgaactcttttttgatgtttaaagcctgcataatattcgctgtgttattattcagcctattactatttccttcatgatggaaatttggtttatcccaattttctattctatcaaaacaccgctacataaaaaatccccatgcacatatttctcctaattgtggaaatattttacctaaaagactctagacatgggatgaaattcccaggttactggaattttaaaatagataggtacttccaaattgacctcttacaaattatatgaatttgtaagcttccaactgttatggagttaccccttttgagaaatctgtgctaaaaggacccaaacaatgctgatgacaatgatcaggataataagtacgctgggaagagaacaaaatgatttagatcttagacaagtcattctaggtgtctccactgtttcagttctcgcgttcgttcattcttgtgctttttcgttttaccaaataaaatagccccttgatgtcatatgaatccacgctatgcttaatgagtattggttagtaaaatgcctataactagtaatcttcatctatgcaattaaatattaattcataaaacacttcaaatgtaaacaataattagtaaatgaaaagtacataatacctcgattagaaaaaaatcactccattaaaagacattatttgtgtgataaaagagtttgccatttttgtatttttctacaaggttaaagaaaactgagtcaacttatacaagtgaattttaaaagactttagggtgggcgtggtggctgacacctgtaatcccaacactttgggaggccgaggagggcagatcacctgaggtcaggagttcgaaaccagcctgaccaacatggtgaaatctcatttctactaaaaatacaaaaaaaattagcccagtgtggtggcacgtgcctataatctcagctacttgggaggctgagacaggagaatagtttgaacctcggaggcggaggttgcagtgaaccaggattgcaccattgcactccagcttgggcaacaagagcgaaactccatctcaaaaataaataaaaaataaataagtaaataaataaaagcctttaacccagaatgctgagtaaattgtccaaaaatgctaacctatgcatttcaatactataggagtcgtgtaggtagaaataactagatgaaatacttctggtatttcaccttcccaactcacacgagccagtgtttttctgtgaataacaaaaacagcagaatttacttgcctatccataagaggt

SEQ ID NO: 27647 - DNA, 2220 bp, Homo sapiens
gttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacggtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaaaaaaaaaaaaaaaaaaaaaaaa

SEQ ID NO: 27648 - DNA, 4864 bp, Homo sapiens
taccagcctgtaggcccagctacttggaagactgaggcaggagaatcactttaagcgggaggcagaggttgcagtgagccaatctcaaaaaagaaagaaaaaaaaaaagaaaaacatatgatgctggggcatctcggcctcaatacctgcatgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaatgatcccgttccctgggcccatgccagtggcctggcctcggctcaacacagccccaacactctggaatggggatgagggggcagtcagctcttgctcctagtaagagagatgcaacagggctctgtggctgagctgggtgccttgcctcacacctgtaatcccaacctttgagaggccaaggcaggaggattgctcgaggccgggaattttgagaatagcctggacaacatagccagaccccatgtctacaaaataataataaaacacacagctatagtccaagctacttggcaggctgaggcaggagggtcccttgagtccgggaattggaggctgcattgagctataatcgcaccactgcactccagcttgggtgacaaagtgagaccctgtctctaaaagaaaaaaaaattggcctgtgagcatgggtttgattttcaaacaggacctggagggtagggacagacagtgctgtcacccttaggtgctgaacactcagaaacgggccagcggcagcccttccctcacctgcagacaccagattgggcagaacagcacatggcacttgcagctcttgcagtgagggcagaacccagtgtcaacccttctgcctgtgggaggggctgctgaggcctgcggagaggccagggtggaggctcgtccccttgtccagcccttggcgttgtctccaccaggtccccagcccaccagtgcagggcgcccctgagcctgctgctgccacggaccctgtctctacccaggacgtccccacaccctcgcagtgtcagggaaatgatcatggtggcggtgacactccgcaggcagggctgctgagagaagctgagaagggtcacactgcaggcaggggcccgtgtgacaagcccctctcaccccgagagagctgaccaggcagctcacgagcagagccacatcccgggagtccgagaaaggtcctggctgggctcagccacctcattggccacgggcagcctttgtcgtgtgagccttgctctcctggggaggctcaggctgacggctgatgtgggcattgccgaaggtaacccgtggcccagtgtatatggccgggtctcctcaagctgcattcattcaagtaggacccagggtgcgtgcccatctccagcccagggcagctcccctgtaagctgggtgagctactgaagccaaggcgggaggcagctgacaacacccacagcccatgcggaggtggtggaaaggctggactcagcagcaacaccaaatcccggaccaggcaaaaaccacccaagactgaggggctcgtgccagagcggtggccacagccccaccccaccggctcaggggttcttcccagcggcgctgatcatgaagtcaacatgcacgcaagtcgtctcaggaaacttcttaatgaaagtgtcggccacggtggtgtgtaggtggctgagctcagattgcagctgctaagacaccagccacttaccaagagaaagccaggctgcttcaaacccagggcccacggcaaaaaagcatcacttccggccggggagtctggaagccacgccttgtgggaggtcacactggcatctaggccttcgcctgcattgcagaaggagagccgggtccccctcctggagaacgctgcgttccccagccccacaccggctttgccaccacacaggctgttgaggcaggaggcggagacttcagaacccactcctgagaacagcggagccaggcgcttagaggaagaccaaatgctgccaggacacggattgtccaggattacattccagcatcttattagaggaccgaagcagagggtgctgtttcaacgccaccaccaggagagaggcagaggggctgtgccgtgctagagtcctcagggagggagtgacctcgaccctggctgtgctgcaagctgactccagccttggtgtcagcagcacccggcgaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacacagagaccccctcgacatcctggacaccacaggggcacctgcaggctgggagaccaggtcctctgtgcatgggcccgggaggcagacctgccctaagggtgatgcacaggctacaggtgctgcacgctccagcgcccactctagacatcagcctccaggttgactaagggtcaggtcatgtttgaaaccgtgcttggctggaccaggacccatggcaagagcacctgggcaccagtgtttagccctggtctgcaggaaggaggacagcagactttaggaccccacagcacggcagtgctgaccatttcacccacttggcctccttgagaaatatggatggggacccctctggggatgggcaaggccttccaggataggctcagttttggtcccctgctttttgaggttgggttaaaattccgaccatggcagaggaagcacagctcaggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaaatacagcttcagcgtgcctgcgatggcgttcacgtccatctcgctcatcatcactgacacgtccttgctatctggaaagagcacggaaatgcagcggcctccttgaagatcctgataaatgaagaaaagacacagagaaggatgtgacatgcctgggccatggagcactctgagatctcatcgtggacaccactgcccacacctccatcccgtcctgcgcaggccgacactcactgacgttgaaggctgccttcagtgcctggatgtctgcggccaccccagacatgcggtagatgcccacctcctccatgcctcggcgctcgatctcctccacgcactggcgcacgatgtagggcaccttggacctctctctcctgcgggaggagggaatgttctcagtgtcctaacagccctgcttgggccataacacaggagacctgctccctatgtgcacacccggaggtggggtgaggacggtgatgaaggtacccaggtctggggctgcacacagagccttctgcatgcctgtcctccctctgcaagctctgtcctcattgcatgtgctttctcaggaacctttcaagcggccagaacccctgcaaatcacacatgacctttgtgggaaggtcaggaggcctgtctaagtcaagtcagcacgggaagggcatctgacagattccaggcctggggtgagcagcctgtgcccccggctgggaggtcagacccggtgttggtcctgccacccacgtgctgtgtgagaggagaatccgtgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggctcatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctgaggaagcaagtgaattctcagaggaagtggtctgtgtctgcatgaactgctctcaaaccaacaaataggcttctcttggcaactgactcgtgacaaagggttcaagattgtttgaaaaaaaaaaaagggggggggggacagggaggcagtaggtcctggaaaagtaaattctttattttacaataagaaagtgattacatattttatttttttttataatggtggaaaattagaagtgattgtgaaaatgatgtctacccgccttgctgatgagtaggatgtgatttggctctttaggaaactgaatttgcagaactgaagaatattgatttataaagggcatggccattgacccagtccatcttatgcaaatctggatgccataaataatatttaaaaatgaaagtattggggtggaggttgcagtgagcggagatcgccccactacactccagcctggtcaacagaaacaaaaaaaaacaaaaaaaaaaaaaaaa

SEQ ID NO: 27649 - DNA, 1978 bp, Homo sapiens
ctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggctgctgcggaggcgaagccaggaagcgctgcttctgcaaggggaggtgcgcgaggcggcgcgggagcgcgcgcagcgggtgcgcagaagactggaggaggcggagcgccacaaggaggacttgaagcccggtaaaccccgtccttacgagccccgcccctagctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgtgacgggcagcttcgcagagtgcagtacagcaccgagtcgctcatggaggagatggccagggcggaccgagagacgcggctgttcggcggtcctcgcgcgctggccatcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggataaaaaaaaaaaaaaaaaaaa

SEQ ID NO: 27650 - DNA, 2666 bp, Homo sapiens
gcctctctgacgagaaggaggccactgggctgaggccaatgaatgggaaagagccagccatgtggtgagctgggagagggcatcccaggccgtgcgacctgcgcttgcaaaggccctggggccggacagttcttggcagagtctgagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtggcacccaggcgagtggtgcccaggtgagtgacagccaggtgaatggtgtccaggtgagtggcatcacccaggtgaatggtgtccaggtgagtggcatccaggtaagtggtgtccaggtggtggcacccaggtgagtggtgtccaggtgaggggcatcacccaggtgaatggtgtccaggtgagtggcatccaggtgggtggtaccgtcgacgtgacaatagctaaaaattattgggctcattgtggacaggcactgtgccgagcttgacatcactgaactcagttcatcctcgccaggagcttgtgggccgtccctagatcagaatccgaggagaaaggacttccacacggcagccagcgagctggagggcggcctcctgccaccaccaggctccctaacccagtcctggatatctgtgaaagaatgagtggatccccacaggccaggtgggcggggacggagggctattgtttcctgggacaaacgtgtgtggggagctgagtgtttctcctttctcagccctgacttcccacagctatccccaaacacactcgtttacactgaagcaccaggagatcagaaccttctggaatcttaatatgcgaggactcggtggagaaggcggcactgaagaagagtcgtccctaggccaggctggagggaaactcaagacggcggcctggccctcctgggtggcggaagtgggagcagcaggagccctggcggatccgggaggccagaagagcggaagcttcctcccctctcaggacagccacaaggactttcgggggtcgtggcagctgctccacttccaacttccagatccctctcactttcctcttcccaccaactccaacctgggaccaagcaggggaaagcagctgcagcccagcttgacgcccctgcaaatggagacctgtgcacctggttgtgagcattttaaagggtgtcacacagggcatacccttcggtgcctggattcctttgatgaaagggcaaagccttgaacctaagtcatcttcgagtcctcagcacttcacccagagcctggcacacagtaggagcacagaaaggtttacatccagcaggagttggccctgagctctgagtccagatcattgctcttggctgaagcagcctgtctactcacaaagatgagcatggtccctgccacgaggaaactcgtggtcctgtggactgcggtgtggagggaaagcttgggattctgagcctgataatgcaccattacatccccactcactcgggctgtgtgaacccagcaagtcacaggatcactgggtggtgaaagaaagaaacactcacagaagcgtctgtgcttggagagccatctggtccgtcattgtgactgctgctctcattgctatcatgggtgtcaccattgccatcactcaaggacttctctccaggccccgaagccaagctggtgcctggttcctctgggttgggagaggggctgggcatggacaggaggagggaaaagggacctgtgctagcaggtgatgccatccaagacatctgcatcctaatccctggaacctgggattccactaggtgccatggcaaagagggattaaggtggcaggtggagtgaaggttgctaatcagccgaccttaaagtagggagatgatcctgaatgagacaaaagagagaaccagtcatggtgtcatgagaaggactcaaaatgcaactgctgactttgaagattaaggggctacaaaccaaggaacgtggtagtctctggaaaagacaaggaatagacgctgcgttggggccaccagaaggaaccagccctgtcaacaccctaattttagcccagtgaggcctgtgctggacttctgacctccagaactgtaaactaataaatgtgtgttgtttctgcc

SEQ ID NO: 27651 - DNA, 2612 bp, Homo sapiens
ggggaggggccggccagccagggcaggcaggggcggcctctctgacgagaaggaggccactgggctgaggccaatgaatgggaaagagccagccatgtggtgagctgggagagggcatcccaggccgtgcgacctgcgcttgcaaaggccctggggccggacagttcttggcagagtctgagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtggcacccaggcgagtggtgcccaggtgagtgacagccaggtgaatggtgtccaggtgagtggcatcacccaggtgaatggtgtccaggtgagtggcatccaggtaagtggtgtccaggtggtggcacccaggtgagtggtgtccaggtgaggggcatcacccaggtgaatggtgtccaggtgagtggcatccaggtgggtggtaccgtcgacgtgacaatagctaaaaattattgggctcattgtggacaggcactgtgccgagcttgacatcactgaactcagttcatcctcgccaggagcttgtgggccgtccctagatcagaatccgaggagaaaggacttccacacggcagccagcgagctggagggcggcctcctgccaccaccaggctccctaacccagtcctggatatctgtgaaagaatgagtggatccccacaggccagctatccccaaacacactcgtttacactgaagcaccaggagatcagaaccttctggaatcttaatatgcgaggactcggtggagaaggcggcactgaagaagagtcgtccctaggccaggctggagggaaactcaagacggcggcctggccctcctgggtggcggaagtgggagcagcaggagccctggcggatccgggaggccagaagagcggaagcttcctcccctctcaggacagccacaaggactttcgggggtcgtggcagctgctccacttccaacttccagatccctctcactttcctcttcccaccaactccaacctgggaccaagcaggggaaagcagctgcagcccagcttgacgcccctgcaaatggagacctgtgcacctggttgtgagcattttaaagggtgtcacacagggcatacccttcggtgcctggattcctttgatgaaagggcaaagccttgaacctaagtcatcttcgagtcctcagcacttcacccagagcctggcacacagtaggagcacagaaaggtttacatccagcaggagttggccctgagctctgagtccagatcattgctcttggctgaagcagcctgtctactcacaaagatgagcatggtccctgccacgaggaaactcgtggtcctgtggactgcggtgtggagggaaagcttgggattctgagcctgataatgcaccattacatccccactcactcgggctgtgtgaacccagcaagtcacaggatcactgggtggtgaaagaaagaaacactcacagaagcgtctgtgcttggagagccatctggtccgtcattgtgactgctgctctcattgctatcatgggtgtcaccattgccatcactcaaggacttctctccaggccccgaagccaagctggtgcctggttcctctgggttgggagaggggctgggcatggacaggaggagggaaaagggacctgtgctagcaggtgatgccatccaagacatctgcatcctaatccctggaacctgggattccactaggtgccatggcaaagagggattaaggtggcaggtggagtgaaggttgctaatcagccgaccttaaagtagggagatgatcctgaatgagacaaaagagagaaccagtcatggtgtcatgagaaggactcaaaatgcaactgctgactttgaagattaaggggctacaaaccaaggaacgtggtagtctctggaaaagacaaggaatagacgctgcgttggggccaccagaaggaaccagccctgtcaacaccctaattttagcccagtgaggcctgtgctggacttctgacctccagaactgtaaactaataaatgtgtgttgtttctgcc

SEQ ID NO: 27652 - DNA, 2290 bp, Homo sapiens
gtcctgtatctatggagacggcaatatggaggcgatcttacatttctttgatttcatctgaacgtccagttcacaattggagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggtaccagtataagggatcaaggacccagtgccacagccttgagccccgaaagcaggctctcttcaaaacaaaacaaaacaaacaaaaaaaacctttaacatgccatataaaagccagtgagtgtttaaaatacgtgcagtatgaataattatgcagctataatccattatttttcattgtggtatagtgtcccaatgtgtgcctgtaccataatgtattcatccagaatgaaggaagtttgggctgtttctatttgggactgttggcattcgtgtatatgtgtccagttacataagtacaagagtttttctggggaataccaggtactatgaaggctcacgtgattttggagtcttatgaaggttttttttttttttttcctgcgtagttgttaaattggtgaccttgcgggatggaaccttctattccaccaccttgctccaccttctgtcttttctggggaatagacgcaggagtagaattgcggaggcttgggccatgtacctgttcacttgctgtagataaaccaaactatttcccaaagtgcatggatttctttagacacccaccagcagcattagagagttcccattcctccacatccttaccaataactgctattgtcagaatttaaaatttttgccagtaatggtaacttgtggttttaatttgcatttccctgattactaatgaatgaggatgagtgtctttttgtaggttattgacactttgcatttcttcatgtgtgaaatttatgatcaagtctgtggccatttttctcttacattatcttgtcttttttctttttggtataagttcttatcccaattacaaactctttgccagttatgcgttgtggatatcttctctcatcttatgatttgtctttactccctttattgtgtcttttgaagaataaaagttcaaagttgaattttaaaggtatcaactttatcagtctttttattttatgattggtgcttttttatgcttctcctaagaagtccttctctacccctaggtcattaagatattttcctctagtatcttctaaagactttatatttttgccttttatatttgtcttttgtctatatggaattgatttttatgaatagtaagtcttgatagctggtagtatacgtcctcctacttaattcttcttcaagattgtcttggctattcttggccctccctttgatctcttacataaatattcaaatcagcttatcatacatgcacataaaacacttcttgagattttgattgggatttaattggacctatagatgaatatgaggagaaatgatatcattataatattgagtcttttactccatgaacatgggctatttctgtattcattaggttatctttcctgtctctcaatagagtgtaaagttttctccatagacatttagcacatccttagttagatttattcataagtattttatatttttgctgttgttatatatgacatattttttagttgttttatttctgtttgttgctagtttttaaaatgtcatttttatataggtattatgttcagtgatcttggcaaatcctcttattctaataatttatttgttaattttcttgttttttcatgcacacatttgtattttaaatggaaaatgacatttttttttctttctagtccttacacctttggctttccttactgcattgttaaatagaaaagtgttgaacagaagtggttatagaggcatctttgttttgtttatcatctcagagtaaaggactgcaatgtttcactattaaaaaaaaaaaaaaaaaaaaaaaaaaaaaaaaa

SEQ ID NO: 27653 - DNA, 5975 bp, Homo sapiens
gtcctgtatctatggagacggcaatatggaggcgatcttacatttctttgatttcatctgaacgtccagttcacaattggagtgatgtttaccttaaccggttgtagactggtggagaaaacccagaaggtagagaatccatcagtctcatttgcctcttctttcccccttattcctcttctcctaagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgaaggagtacatggaccagctgtggtttgagaaagcggaggggatgttctgtgtcggcctacgggccaccctgccctgccacaggctgatctgccgcccaccatccctgcagctgcccatgtgtgctgtgggagatacgactgaggcctttttctgcctggataatgtgggggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtcctgcagagctacagtaatattgaggaggactgcaccatgtgcccatcctggtgcctgacggtgcgggcacgaggccacagctatttcgctggctttgagcaccacatcccccagtattccctagatgtccccaagctatttccagcagtgtcctccggtgagcccacctaccgcagcctgctcctggtcaacaaagactgcaagctgctgaccttcagcctggccccccagagaggctcagacgtcatccttcggcccacttcgggccttgtggcacccggggcccaccagatcatcctcatctgcacctaccctgagggcagctcctggaagcagcacactttctatctgcagtgcaatgcttccccccagtatctcaaggaggtgagcatgtacagccgggaggagccactgcagctgaagctggacacccacaaaagcctctacttcaagcccacctgggtgggctgctcctccaccagccccttcaccttccgcaacccctcgcgtctgcccctgcagttcgagtggagggtctctgagcagcatcgaaagctgctggctgtccagccctccagggggctaatccagcccaacgagagacttacgctgacgtggaccttcagccctttggaggagaccaagtacctgttccaagtggggatgtgggtctgggaagccggcctgtccccaaatgccaaccccgctgccaccacccactacatgctccggctggtgggcgttgggctcaccagcagcctctctgcaaaggaaaaggagctggcctttgggaatgtgctggtgaacagcaagcagtccaggttccttgtcctcctgaatgacggcaactgcaccctctattaccgcctctacctggagcagggcagccctgaggccgttgacaaccaccccctcgctctgcagctggaccgaacagaggggagcatgccaccccggtcccaggacaccatctgcctgactgcctgtcccaagcagcggtcccagtactcctggaccatcacctactctctcctttcccacagagataacaaggctggggagaagcaggagctgtgctgcgtctccctggtggccgtgtaccccttgctttccatcctggatgtcagctccatgggcagtgctgagggtatcacccggaagcacctgtggcgcctcttctctctggacctgcttaacagttacttggagcgtgaccccaccccctgtgagctcacctacaaggtgcccacccggcacagcatgagccagatcccccccgtcctcacccctttaaggcttgacttcaatttcggggccgcaccattcaaggccccaccttccgtggtattcctggccctgaagaacagcggagtggtgtccctggactgggccttcctccttccaagtgaccagcggattgacgtggagctctgggcagagcaagcagagttgaattccactgagctccaccagatgcgcgtgcaggacaattgcctcttctccatcagccccaaggctgggagcctgagtcctgggcaggagcagatggtggagttaaaatacagccacctgttcatcggtactgatcacctcccagtgctcttcaaggtgtcccatggccgggagatcctgctaaatttcataggtgtgacagtgaagccggagcagaagtatgtgcacttcacctctactacccaccagttcatccccattcccattggtgacacgctacccccacggcagatttatgagctgtataatggtggctcagtgcccgtgacatatgaggtccagaccgatgtcctgtcacaggttcaggaaaaaaattttgatcaccccatcttttgctgcctcaaccccaaaggggagatccagccaggcagcactgcccgggtcttgtggatcttctcacctatcgaggccaagacctacacggtggacgtgcccatacacatcctgggatggaactcggccctcatccacttccagggagtgggctacaacccccatatgatgggggacacagccccattccacaacatctcctcgtgggacaacagttccatacactctaggctggtggtgcctggacagaatgtcttcctgtcccagtctcatatttccctgggaaacatacctgtgcagagcaagtgcagccgcctgctcttcctcaacaacatctccaagaacgaggaaattgccttctcctggcagccaagtcctctagattttggggaggtgtctgtgagtcccatgataggggtggtggctcctgaagagacggtcccatttgtggtgaccttgagggcctctgtgcatgccagcttctacagtgcagacctggtatgcaagctgtactcgcagcagctcatgaggcagtatcacaaggagctgcaggagtggaaggacgagaaggtgcggcaggaagtggagttcaccatcaccgacatgaaagtgaagaagagaacatgctgcacagcctgtgaacctgcgaggaagtacaagacactgcctcccatcaagaaccagcagtctgtcagccggcctgccagctggaaactgcagaccccaaaggaggaggtgtcctggccctgcccccagccaccctcgccaggcatgctctgcctgggccttactgcccgagcccatgccaccgactactttctggctaacttcttctcagagtttccctgccactttttgcaccgggagctgccaaagaggaaggcccccagggaagagtcagagacttctgaggaaaaatcccctaacaagtggggccctgtttccaagcagaagaagcagctcctggttgacattctcaccacaataatcaggggcctgctggaagacaagaacttccatgaggctgtggaccaaagcctggtggagcaggtgccgtacttccgccaattctggaatgagcagtcaactaagttcatggaccagaaaaacagcctgtacttaatgccaatcctgcctgtaccctccagcagctgggaggatgggaagggcaagcagccgaaggaagacagaccagagcactatccagggttgggaaagaaggaagagggggaggaggagaagggtgaagaggaagaagaagagttggaggaggaagaggaggaagaagaggagacagaagaggaggagttgggcaaggaggagatagaggagaaggaggaggagagggatgagaaggaagagaaagtgagctgggcgggcatcgggcccacaccacagcctgagtcccaggagtccatgcaatggcagtggcaacagcagctgaatgtcatggtgaaggaggagcaagaacaggacgagaaggaggccatcagaaggctcccggccttcgccaacctgcaggaggcgctgctggagaacatgatccagaacatcctggtggaggcgagccgcggggaggtggtactcacctcgcggccacgcgtcatcgccctgccgccgttctgcgtgcccaggagtctgaccccggacacgctgctgccgacgcagcaagcagaggtactccacccggtggtgccacttcctaccgaccttccgtaaatgcccgcgcccagcctctccgacatgccgctaggggtcacgcctggccccctctccaccgccagtaaaagcatctagtctttaaaaaaaaaaaaaaaaaaaaaaaaaaaaaa

SEQ ID NO: 27654 - DNA, 7101 bp, Homo sapiens
tctacctacagcgtcctgtccaccatgccctcagactcagaaagcagcagctccctcagcagtgtgggcactaccgggaaggcgccgtccccaccacccctcctcactgaccggcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcaaaggagtcggagaaatacagggaggagcgggacgctgtgtacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggrggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggtactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacrccagactcagctcttttctagcgactgaaagtagaagtctgtcygtctatgaacatgcgggggaaggatccggaaccaggacccagaagcacctcctttgtagacagagggccacggctgcgtgcgatccaggcccaggmccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacatcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgt

SEQ ID NO: 27655 - DNA, 1907 bp, Homo sapiens
acttgctctgcagctcccagaggtggtggttgtgttacgaaggctgaccctgccaatggccgacaaaatggtgcgcacccccaagtgctcgagatgcaggaaccatggcttcctggtgcccgtcaagggacacgcgggcaaatgccgctggaagcagtgcctctgcgagaagtgctacctgatctccgagcgccagaagatcatggccgcgcagaaggtgctcaagacgcaggccgccgaggaggagcaggaggcggccctgtgtgcgcaggggcccaagcaggcctccggggctgcggccgccgcccccgcccccgtccccgtcccggccgcgagcctccgcccgctgtccccggggactccctccggagacgccgacccgggacccgagggccgcgcggccgcttgcttcttcgagcagcccccgcggggccggaaccccggcccgagagccctccagccggttctgggcggccgcagccacgtggagccgagcgagcgagccgccgtggcgatgcccagccttgcgggacccccttttggggcggaggccgcaggcagtggctaccctggccccctagacctgcgcaggccgatgcggaccgtgcccggcccactgttcaccgactttgtgcgccctctgaacatcaacccggaccgtgcactgggccctgagtaccctggtggctccagcatgcacccctactgcccgttcccgctgggctacctggacgcccctcctggcgtccccctgcagcagggcttccggcatgtgtcccgcagccagtaccaaggcggaggcttggtgtcagaaccaggaggagacttccagccaagctactacctgccgccgccgccgccgccactgccgccccttccaccgcttccaccgcagccccagttcctcccgccaggctacctctctgcgctccacttcctccccccgccaccgccaccaccacctccatcatctttctcactgaccgtcctgtttgatactgacaaggagaacactgatgaccaggatgcagaggtactgtcgggtgagcccagccagccatcgtctcaggagcagtccgactaggccccaggcccgccctcctggccagcagagtggggcactggggggcaacagcaacagttttcctgtcttcattcagtgatatgtagggaggaaggaggttgatagcatagatggcaactgattcccagtttaagataggaggaaggagagcaatttctaagtttcaatcctgcgctgtacagttgaagaagagtgtggaggaagctattaccaggggagggccagggctctgaggagtgggcgctgggagaagctcccatttaggaatgaatttaactgtccttgggttacactaccatttattggaacaagccccagaggcagtatttgatttcctcaggccccactctaggacaggaggcaccatctatttcagccttctgctgcctttgcctggtcctccaggttgctgggggcaccacagacatcaagattccagttcatccaggtggctggagccagcagccaggaccagggtcgttgacagcaggttctgcagcatcctgccttgctgctctgtcccccacatcttcctggccacagccccttgcccctcctctaaggggttttactagcaagcatcctggctgctggggctacttcattccccctccataaagtttcagccattatgggcactggttttaaaaaatttattagtttgactatttgatggttttatagtgattgccaactttaaaaagtaggctgttcataagcactgatgcagtccctagggaatagaatggtgcttctgatcacctgtgacatgaacagtttcttctgtgaggacagttggctattgaaataaaatgagcaatgg

SEQ ID NO: 27656 - DNA, 2857 bp, Homo sapiens
gagagaggcgatgcttgaagttcattggtctttgtgagacaggatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtccacatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagccttgtacccaactccagcctgtgccctctgcccctgcagaactcctgtgggcctctgctgctcagccatcccccggaagcctcgcccttgtcctggactccggtgcctcctggcccttgggtccctggacactggctgcctccaggcttctccatgccaccaccagtggtgtgccgcctgctgtaccaagaacctgctgtctctctgcctcccttccctggctttgaccctggcacctccctccagctgcccactcatgggcccttcaccacctgcccaggatctcacccagtgctgacagctcctctttctggagagccccaagggccccctagccagccccgcacacactcaactctgatactccagccctgtggcaccccagaccctcttcagctacagccacaggtcctgggaaagaagtgggatctagggccctgggaggaggttgagcctggggaaggaaaaagcaggaaactgaaggaagcaggggctgaggaacacttagagggtgggcagaagcgggggttcccagtctgcttgtctccctttcccttgcaggcctctggagcctcgtgcctggcccggacatctggcccctcagagtggcagctgcagcaagaggcagctgaagccctcgtggggctgaaagattcatcccaggctcctcgtgtgaccccttctgtgccccccaaccctgcctggatctccctgcttcacccctgtggcccaccaggtgggccatgaaaggggaggatggatagggatggctgggaaatggagatcactgaagtacacagggactaaccaaggagatgagggggtcgacaggttgaacgtcttcaggcccaggaccccaagctcctcagcctggcccctgggattgcagttgagagttattcagtgaatcctttttatcagtttggcactcgacagcaaatttcttgatatcaaggaaagtggggcactgagaaaggcagggacttgcccaagggcatatagtgagacagtggcagggaacccaatgctctgtctctggacccaggctgcctgctgaagtctgaagtggggtctggcctgggaggaggtctgataagtgccttcaaggagcttacgttctagttagggaaattggatgccttcacaaggctcagtgacaaacctgaagaagattggaggaaccttgaagagtgagaaacacctagggggacagacagggaaagctgcgaattctcttgtccaaatagtggattgggcagactggcctggaggaaatgctagagcagagggaaaggaggctggagaggcttctgatggtggagatctggcatgccaggcttaggtgtctagaacagcaactgtatgtgaaggggagccagggaacgtttctgaactaagcaaggacaaattcagagaccctgagctttagaaagacaagtgggtggctttgatggacggtttggaggaggcaagactggaggtgggaaaattagcaaggaggtctgtgaaataatccaggagaacaatgatgaggcctggattggattcggtaaaaagagggggttgctagaaggaaaaacaggtgtgacctgatcctgccccttccttcttgcctgtagctcctgctggaggaagaggattccagcctgttggcccctgtcttcgacccagcccagccccctctgttgctctgcatattggccgtctggggtccatctccctcctgagctagaaacccagagatggaggctgtcttgctatggcagggaggtgacagcctgctggcactgtatatttagtgtcttacttaaggatttatgcatggaatttaatgtagtacaagcttcgggcttttttgtttgtttgtttgtttgtttgtttaagctttcaggtgcttcattagctttcagttcctttggtagtgtgggcatttccttggctgacagtggatattcttgtacccttcttgggtcctgggatctcttgaaatccccaataaagagagagttgtgctatttaagctgaccagtatctataaacgtgtttgcatgagtttacatcccaggattccatgattctgtaaatgcctatgcattcatgtctgtctccatgcatgtgaaaacaggagagtgttttcattttgtgtctaggtttgtgtgagtaagcaagaaataaacctttgttgttgtaagccactgagatttggagagtgttaccacagcctaacctagtctatcctgactgacagaaaggacttgttcatttcgcttctcaaagtgaaaaatctgttatccaatagctaccatagatgaaaacaaacttggatttttttctttgtccaaataaaaaaaatgatgtaaag

SEQ ID NO: 27657 - DNA, 13971 bp, Homo sapiens
attccggaagagctgactccagcctgtccatgcacggctacaatgtttaggattgggaggagacagctctggaagcatagcgtcactcgagttttaacgcaaagactgaagggagagaaggaagccaagcgggctcttttggatgcgaggcataactacttatttgcaattgtggcttcctgtttggacctgaacaaaaccgaagtggaggatgccattcttgaagggaatcagattgaaagaattgatcaactttttgctgttggaggtctccgacacctcatgttttactatcaagatgtggaggaagcagaaacaggacaacttggctctctaggaggggtaaatcttgtttctggaaagattaaaaaacctaaggtgttcgtgaccgagggaaacgatgtggctcttactggggtatgtgtgttcttcatcaggactgacccttccaaagccatcacccctgacaacatccaccaggaggtgagttttaacatgttagatgcggcagatggaggcctgctcaacagtgtgagacgtttgctgtcggacatcttcattcctgctctcagagccacgagccatggctggggcgagctcgagggccttcaggacgcagctaacattcgccaggagttcttgagctccctggaaggctttgtgaacgtcctgtcgggtgcacaggagagtctgaaggagaaggtgaaccttcgaaagtgtgacatacttgaactgaaaaccctaaaggaacctacggactacttgactctagcaaataaccctgagactttgggaaaaatagaggattgcatgaaagtatggatcaaacagacagaacaggttcttgctgaaaacaatcagctgctgaaggaagcggatgacgttgggccacgagcggagctggagcactggaaaaaaagactctccaagtttaactaccttttggaacaattgaaaagcccggatgtgaaggctgtgctggcagtgcttgcggcggccaagtcgaaactgctgaagacttggcgggagatggatattcgaatcactgatgcaactaatgaagcaaaggacaatgtgaaatacttgtatacacttgaaaaatgttgtgaccctttgtacagcagtgatcccctatccatgatggatgctattcctacacttataaatgcaattaaaatgatctatagtatctctcattactataatacctctgagaagatcacatctctgtttgtaaaggtgacaaatcagattatatctgcatgtaaagcctatattaccaataatggaaccgcttccatctggaaccagccacaggatgttgttgaagaaaaaatactatctgcgattaaactgaaacaggaataccagctctgctttcacaagacaaaacaaaagcttaaacaaaatccaaatgcaaaacaatttgattttagcgagatgtatatttttggaaaattcgaaacttttcaccgacgccttgccaagataatagacatctttacaaccctcaagacgtattcagtcctgcaagattccacaattgaagggctggaagacatggccactaaataccagggcattgtggcaaccataaagaaaaaggaatacaatttcctagaccagcggaaaatggattttgaccaagattacgaagagttttgcaagcagactaatgaccttcataacgagttgcggaagttcatggatgttacatttgcaaagattcaaaacacaaatcaagctctaagaatgttgaagaaatttgaaagattgaatatacctaatcttggtattgatgacaaatatcaacttatccttgagaactatggggctgacattgatatgatttcaaagctgtatacaaagcagaaatacgatcctcctctggctcgaaaccagcctcccatcgctggaaagattttgtgggcccgccagctcttccataggattcagcagcccatgcagcttttccagcagcacccagctgtgctaagcacggcagaagccaaacctataattcgcagttacaacaggatggccaaggtcctcctggagtttgaggtcctcttccacagggcgtggcttcggcaaattgaagaaattcatgtaggtcttgaggcttcattattggtgaaggctccaggcacaggggaattgtttgtaaactttgaccctcagatattaatcttatttagagaaacagagtgcatggcccagatgggtctggaagtctctccactggcaacttccctcttccagaaacgagatagatacaaaaggaacttcagtaacatgaagatgatgctagctgaatatcagagagtgaagtcaaaaatacctgctgccattgagcaattgattgtccctcacttggccaaagtggatgaagctctccaacctggcttggctgcactgacctggacatcactgaatattgaggcttatttagaaaacacttttgcaaagatcaaggacctggagttgctgcttgacagggtcaatgatttgattgagttccgcattgatgccattctagaagaaatgagcagcacgcctctttgtcagcttccccaggaggagccactaacctgtgaagagtttctccaaatgacaaaggatctttgtgtaaatggtgcacaaatactacattttaaaagctcattagtggaggaggcagtcaatgagcttgtaaatatgttgctggatgtggaagttttatctgaagaagaaagtgaaaaaatatccaatgagaatagtgttaattacaaaaatgaaagttcagcaaaaagagaagaaggaaattttgacaccttgacatcatctattaatgccagggccaatgccctgcttttgacgacagtcacgaggaaaaagaaagaaactgagatgttaggggaagaagcccgcgagttactctctcatttcaaccatcagaacatggatgctcttctgaaagttacaaggaatacactagaggccattcgcaaacgtattcattcctctcacacaattaacttccgggacagtaacagtgcctctaacatgaagcagaacagtttgcccattttccgggcaagcgtcactctggccattcccaacatcgtcatggcccctgccctggaagatgtacagcagaccctgaacaaagccgtggagtgcatcatcagtgtccctaagggggtcagacagtggagcagtgaactgttgtccaagaaaaagatacaagaaagaaaaatggctgctttgcagagtaatgaagacagtgattctgatgttgaaatgggagaaaatgaacttcaagataccttggagatagcatctgtaaatttacccattcccgtgcaaaccaagaactattataagaatgtttctgaaaacaaagagattgtaaaattagtttctgtgcttagcacaattatcaactccaccaaaaaggaagttattacatccatggattgcttcaaacgctacaatcacatttggcaaaagggaaaagaagaagccattaagacatttattacacagagccccttgctttctgaatttgagtcccagattctctatttccaaaacctagagcaggaaattaatgctgagcctgaatatgtctgtgtgggttccattgctctgtacacagctgacttgaagttcgccctgactgctgagacaaaggcctggatggttgtcattggacgccactgtaacaaaaaataccggagtgagatggaaaacatttttatgcttattgaagaattcaataagaaactaaatcgtccaattaaggacctagatgatattcggattgcaatggcagcgctgaaagaaataagggaggagcaaatctccattgactttcaagtaggacctattgaggaatcttatgccctgcttaacagatatggacttctgatagcaagggaagagatagacaaagttgatacactgcactatgcttgggagaagctgctggcacgtgctggcgaagtccagaataaattagtctcactgcagcccagtttcaagaaagagcttattagtgctgtggaggtattcctccaagattgtcaccagttttatctggactatgatttgaatggtccaatggctagcggcttgaagccccaggaagccagtgacaggcttatcatgtttcagaatcaatttgataatatctatcggaaatacatcacatatactggaggagaggagctttttggcctgccagctacacagtatcctcagcttcttgaaataaagaagcaactaaatcttctacagaaaatatatactctgtacaacagtgtcatagaaactgtaaatagctattatgatattctttggtcagaggtgaatattgaaaaaattaacaatgaactcttagaattccagaacagatgtcgaaagcttccccgggccttgaaggactggcaggcttttttggacctgaagaagatcattgatgatttcagcgagtgttgcccgctgctggaatacatggccagtaaagccatgatggagcggcactgggaaaggataaccaccctcaccgggcacagtctggatgtggggaatgaaagctttaagttaagaaatatcatggaggcacctcttctgaaatataaagaggaaatagaggacatctgtatcagtgcggtgaaagagagagacattgagcaaaagctgaagcaagtgattaatgaatgggacaataaaacattcaccttcggcagctttaaaacccgtggagagctcctcttgagaggagacagtacctcggaaatcatcgccaacatggaggacagcttgatgttgctgggatccctactgagcaacaggtacaatatgccattcaaagcccagattcaaaaatgggtgcagtacctttccaactcaacagacatcatcgagagctggatgacggtgcaaaacctgtggatttatttagaagctgtctttgtgggaggagacattgccaagcagctgcccaaggaagccaagcggttttctaacatagataaatcttgggtgaagatcatgactcgggcacatgaagtgcccagtgtagtccagtgctgtgttggagatgagaccctggggcagctgttaccacacttgctggaccagttggaaatatgccagaaatcccttactgggtacttggagaaaaaacgactgtgctttcctcggtttttcttcgtctcagatcctgcccttctagagattctggggcaggcgtcggactcccacactatacaggcccatttgctgaatgtgtttgacaacattaaatctgtcaagttccacgaaaagatctatgatcgaattctgtcaatttcctctcaagagggtgagacgattgaattggataaacctgtcatggcagagggcaatgtggaagtttggcttaattctcttttggaagaatctcagtcctcattgcatcttgtgattcgccaggcagccgcaaatattcaagaaacaggtttccaactaactgaatttctttcatccttccctgctcaggttggattattaggaattcagatgatatggacacgggattcagaagaagcccttagaaatgccaagtttgataaaaaaatcatgcagaaaactaatcaggctttcctggagctactcaatacattgatagacgtcaccacgagggatctgagttccacggaacgagtgaaatacgagactctgattactattcatgtgcaccaaagggatatctttgatgacctgtgtcatatgcatatcaagagtcccatggactttgagtggctgaaacagtgcagattttactttaacgaagattctgacaagatgatgattcacatcacagatgtggcgttcatataccagaatgaatttttaggctgcactgacaggcttgtaataactccacttacagacagatgttacatcacgctggctcaagctctgggaatgagcatggggggagcccctgctggacctgcaggcacaggcaaaacagaaaccactaaagacatgggacgatgcctcgggaaatacgtcgtggttttcaattgttcagaccagatggatttccgaggacttggacggatttttaagggactggcacagtctggatcctggggttgttttgatgaatttaaccgtattgatctaccagttctctcggttgcagcccagcaaatttccattattctgacatgtaaaaaggagcacaaaaagtcttttatctttactgatggagataatgtgactatgaaccctgaatttgggcttttcttaaccatgaatcctggctatgccggacggcaggaactccctgaaaacttgaagattaatttccgctcagtggccatgatggtgcctgaccgtcagattatcataagggtgaagttggctagttgtggcttcattgacaacgttgttttggccaggaagtttttcacgctctacaaactgtgtgaggagcagctttctaagcaggttcattatgactttggcctgcgtaacattctgtcagttcttcggaccttgggagcagcaaaaagagccaatccaatggatacggagtccacgattgtcatgcgtgtactacgggacatgaatctttctaaactgattgatgaggatgaacccttgtttttgagtttgattgaagatctctttccaaatattcttctggacaaggcaggttaccctgaactggaagcagcaattagtagacaggttgaagaagctggtttaatcaaccatcctccttggaaactgaaggtcatccagctattcgaaacgcagagagtgcgacatgggatgatgactctggggcccagtggggctgggaagaccacctgcatccacaccttgatgagagccatgacagattgtggaaaaccacatcgggaaatgaggatgaatcccaaagcgattactgccccacagatgtttggtcggctggacgttgccacaaatgactggactgatgggatattttctacgctttggaggaaaacattaagagcaaagaaaggggaacatatctggataattcttgatggtccagtagatgccatctggattgaaaatctgaattctgttttggatgataacaaaactctaacccttgccaatggtgatcggattcccatggctccaaactgcaagatcattttcgagcctcataacattgacaatgcttctcctgccaccgtctcaagaaatggaatggttttcatgagctcttctatccttgattggagtcctattcttgagggttttcttaagaaacgctcacctcaagaagcagaaattcttcgtcagctgtacaccgagtctttcccagacttgtatcgcttctgtatccagaacttagaatacaagatggaggtgctggaggcctttgtcatcacacagagcattaacatgcttcaaggcctgattcctctgaaggagcaaggcggggaggtgagccaggctcacctggggcggctgttcgtgttcgcgctgctgtggagcgcgggggcggcgctggagctggacggacggcgccgcctggagctctggctgcgctctcggcccacagggacgctggagctgccgccgccagcggggcccggggacaccgccttcgactactatgtggcgcccgatggtacatggacgcactggaacacgcgtacccaggaatacctgtatccgtctgataccaccccagagtatggttctattctggtgccaaatgttgacaatgtgaggactgactttctaattcaaaccattgctaaacagggcaaggctgtgctattaattggtgaacaaggaacagccaaaacagtaataattaaaggatttatgtcaaaatatgatcctgaatgtcacatgatcaagagtctgaatttttcttctgcaaccaccccactgatgttccagaggacgatagagagctatgtggataaacgaatgggtacaacatatggccctcctgcgggaaagaagatgactgtttttattgatgatgtgaatatgccaataatcaatgagtggggagatcaggttacgaatgagatagtgcgacagctgatggaacaaaatggattctataatctagagaagcctggggagttcaccagcatcgtggacatccagtttttggcagccatgatccatcctggtggtggacgcaatgacataccccaaagactcaagaggcagttctctatatttaattgcacgttgccctctgaagcttctgtggacaagatctttggtgtgattggggtaggccactactgtactcagaggggtttctcagaagaagtgagagattctgtgacaaaattggtgcctctgacacgccgactatggcagatgaccaagattaaaatgcttcctacccctgcaaaattccattatgtgtttaacctacgagatctttctcgggtctggcagggaatgctgaacactacttcagaggtcatcaaggaaccaaatgatctgttaaagctgtggaagcatgagtgtaaacgtgttatagctgaccgtttcacagtgtccagtgatgtgacctggtttgataaggctttagtaagtttggtagaggaggagtttggtgaagagaaaaaactcttggtggattgtggaattgacacatattttgtggatttcttgagagatgcacctgaagctgcaggtgaaacatctgaagaggctgatgctgaaacacctaaaatttatgagccaattgaatcttttagtcacctaaaagagcgtctgaatatgttcctgcagctctataatgagagcatccgtggcgccggcatggacatggtgttctttgcagatgccatggttcacttagtcaagatctctcgtgtcattcgtactcctcagggaaatgccctcctggtcggggtgggcggatcaggaaagcagagcctgacgaggttggcttcattcattgctggctacgtttccttccagatcactctgacgagatcctacaacacatcaaatctgatggaagatctgaaggttttgtatcgaacagctggtcagcaaggcaaaggaatcacttttattttcacagacaatgagattaaagatgagtcatttttggaatatatgaacaatgttttatcatcaggtgaggtctctaacctatttgctcgagatgaaattgatgaaattaatagcgacctggcatcagtcatgaaaaaagaattccccaggtgccttcctaccaatgagaacctgcacgactacttcatgagtcgggtccgacagaaccttcatattgtgctctgcttctcgccagtgggggagaaatttcgaaacagagctttgaagttccctgccctaatttcaggatgcacaattgactggttcagccgatggcccaaagatgctttagttgctgtgtctgaacacttcctcacttcctatgatattgactgcagtttggaaatcaagaaggaggtggtccaatgcatgggctccttccaggatggggtggctgagaagtgtgttgattattttcagagattccgacgttctacccacgtgacgcccaaatcatacctctcctttattcagggctataagttcatatatggagaaaagcatgtggaggtgcggaccctggccaacagaatgaatactggattggaaaagctcaaagaagcttcagagtctgttgcagccttgagtaaagaactggaagcgaaagaaaaggagctacaagtggccaacgataaagccgacatggtcttaaaagaagtgacaatgaaagcacaggctgctgaaaaggtcaaggctgaggtacagaaggtgaaggacagggcccaggccattgtggacagcatctctaaagacaaagccattgctgaagaaaaactggaagcagcaaaaccagctttagaagaggcagaagctgcattgcagaccatcaggccttcggacatcgccactgttcgcacgttgggccgcccccctcacctcatcatgcggatcatggattgcgtactgctgctgtttcaaaggaaagtcagtgctgtgaaaattgacctggaaaaaagctgtaccatgccctcctggcaggaatccttaaaattgatgactgcagggaactttttacagaacttacagcaattcccaaaagacacaatcaatgaagaggtgatagaatttttgagtccttactttgaaatgcctgactataacatcgaaactgctaaacgcgtatgtggaaatgtagctggtctttgttcctggacgaaagctatggcttccttcttttctataaacaaagaagtactgcctctgaaggccaacttggtggtgcaagagaatcgccatctcctggccatgcaggatctgcagaaagcccaggccgagttggatgacaagcaggcggaacttgacgtggtgcaggctgagtatgaacaggccatgactgaaaagcagaccttgcttgaagatgcagagcgatgcagacacaagatgcagacagcttccacgctcatcagtggcttggcaggtgaaaaagaaagatggacagagcaaagccaagagtttgctgcacaaactaaaagacttgtaggggatgtactgttggctacagcttttctatcttattctggtccatttaaccaagagtttcgtgatcttctgttaaatgactggcggaaggaaatgaaagcccggaaaattccatttggaaagaacctaaatctcagtgagatgttgattgatgctcctactattagtgaatggaacctccaaggtctgccaaatgatgacttgtccattcaaaatggaattattgtcacgaaggcatctcgttaccctttgttaattgatccacagactcaaggcaagatctggattaaaaataaagaaagccgaaatgaactccagatcacgtctttaaatcacaagtacttcagaaaccacctggaagacagcctttctcttggaaggcctttgcttattgaagatgttggagaggaactagatccagcactagataatgttttggaaagaaacttcattaaaactgggtctacctttaaggtgaaagttggtgacaaggaagtagatgtgttggatggctttagactctacattaccaccaaattgcctaacccagcctacacccctgagataagtgcccgtacctccatcattgacttcactgtcaccatgaaaggtctagaagatcagttactggggagggtcattctcacagagaagcaggaattggagaaagaaagaactcatctgatggaagatgtaactgcaaacaaaagaaggatgaaggaactagaagataacttgctttaccgcctgacaagtacccaggggtccctggtagaagatgaaagtctcattgtcgtgctgagtaacacaaaaaggacagccgaggaggtgacacagaagctagaaatttctgctgagacagaagttcaaattaactcagcccgggaggaatacagacctgtggctacgcggggcagcatcctctacttcctcattactgagatgcgcttggttaatgagatgtatcagacttcgcttcgccagtttctgggcttatttgacctttccttagccaggtctgtcaagagcccgattacaagcaagaggattgctaatatcatcgagcacatgacctacgaggtttataagtatgctgcccgagggctgtacgaggagcacaaattcctgttcaccttgttgcttaccctaaagattgacatccagaggaaccgagtcaagcatgaagagtttctcactcttattaaaggaggtgcctcattagaccttaaagcttgtcctccaaaaccatcaaaatggatcctggacataacatggctgaatttggtggaacttagcaaactcagacagttttcagatgtccttgaccagatatcgagaaatgagaaaatgtggaaaatttggtttgataaggaaaacccggaggaggaacctcttccaaatgcctatgataaatctcttgactgcttcagacgtcttctccttattagatcctggtgtcctgacagaaccatcgcccaggcccgcaagtacatcgtggactccatgggagaaaaatatgccgaaggtgttattttagacttggagaagacgtgggaggaatctgatccacggacgccactcatctgtctcctgtctatgggctcagaccccacagattccatcattgccttggggaagagattaaaaatagaaacccgttatgtgtccatgggccagggccaggaagtccatgctcggaagctcttgcagcagaccatggcgaacggaggatgggcacttctgcagaactgccatctgggacttgatttcatggatgagctgatggacataatcatagaaactgagcttgtacatgatgcgttccgcctctggatgaccaccgaggctcataagcagtttcccattacactccttcagatgtccattaaatttgccaacgatcctccacaaggactccgggcaggactgaaaagaacatatagtggtgtcagccaagacctgctggacgtgagctctgggtcccagtggaagcccatgctgtacgcagtggctttcctgcactccactgtccaggagaggcgcaagttcggtgccctggggtggaatatcccctacgaatttaaccaagcggactttaatgccactgtgcagttcatccaaaaccacttggatgacatggatgtcaaaaagggtgtctcctggaccaccatccgctacatgataggagagattcaatatggaggcagagtcactgacgactatgataagagattgttgaacacatttgctaaggtttggttcagtgaaaatatgtttggaccagatttcagtttttaccaaggatacaatattccaaaatgcagcacagtggataactatcttcagtatatccagagtttgcctgcctatgacagccctgaggtgtttgggctgcaccccaatgctgacatcacctaccagagcaagctggccaaggacgtgctggacaccatcctaggcatccaacccaaggacacctctggtggaggggatgagacccgggaggcggtggtggcccggctggctgatgatatgctggagaagctgcccccagactatgtcccctttgaagtaaaagagaggctgcagaagatggggccattccagcctatgaacattttcctcaggcaggaaatagacagaatgcaaagggtactcagccttgtccgcagcaccctcactgagctgaaacttgctattgatggcaccatcatcatgagcgaaaatctgcgagatgcattggattgcatgtttgatgctagaatccctgcttggtggaaaaaagcttcttggatttctagtacactgggtttctggtttactgaacttatagaaagaaacagccagtttacctcgtgggttttcaatggccgacctcactgcttttggatgacgggtttttttaacccccagggatttttaactgcaatgcgacaggaaataactcgggccaacaaaggctgggctctggacaatatggtgctttgcaatgaagtcaccaaatggatgaaggacgacatttctgcccctcccacagagggtgtctatgtctatggcttatatcttgaaggtgctggctgggacaagaggaacatgaaactcattgaatcaaagccaaaagtgctctttgagttgatgcctgtcataaggatttatgcagaaaacaatactttacgagatcctcggttttactcctgtcccatctataagaagccagttcgaacggacttgaactacattgccgctgtggatctcaggacagcccagacccctgaacactgggtgctccgtggggttgcccttctgtgtgatgtcaagtaacatgtggggagtgtccccacccaatgctttggaaaatgcaagatctaaattatt

SEQ ID NO: 27658 - DNA, 13860 bp, Homo sapiens
tcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctgggtcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacagaagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcgtttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtgaaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccacatctccctgcagtatctgacaacatcaatgaggtgacatttcatacaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaaactaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctatgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccgtaaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggagacagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcagtactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttct

SEQ ID NO: 27659 - DNA, 2089 bp, Homo sapiens
cgccgccgcgccggctgcatcctcgcctccacctcgctcaccccctcctccccgcactttctcggcgctccctccctctcggctcgcacagctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaggtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaaaaaaaaaaaaaaaaaaaaaaaaa

SEQ ID NO: 27660 - DNA, 3976 bp, Homo sapiens
caagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggaggtggaaaagtcggtcctaggcggcgggaaactgccaaggggcgcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaaggattgggagatcctgcttgcttttatgttggtgtaatctttattttaaatggactaatgatgggattgttcttcatgtatggagcatacctgagtgggactcaactgggaggtcttattacagtactgtgcttctttttcaaccatggagaggccacccgtgtgatgtggacaccacctctccgtgaaagtttttcctatcctttccttgtacttcagatgtgtattttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaagaacmatgattttaataatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataccagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaacttta

SEQ ID NO: 27661 - DNA, 538 bp, Homo sapiens
accccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactgctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcaaaaa

SEQ ID NO: 27662 - DNA, 441 bp, Homo sapiens
accccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcaaaaa

SEQ ID NO: 27663 - DNA, 698 bp, Homo sapiens
accccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactgtgagtagatgatctcctgtcaaagacagttaacaaatcctcggaatattgcttcatgtacagttattggagatgagtaacttacattctcttaattgtaatggttccttggaaagtcatcgtggaaaatgaaggctggctcatacattttcccagacaggaatttggctgccaacagggaattctaaacaactaaaaactccagatgatgaatgcacaacataatgatggttaaattaaaaaaaaaaaagagcacgacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcaaaaa

SEQ ID NO: 27664 - DNA, 1788 bp, Homo sapiens
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacaagggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagacaaaaaaaaaaaaaaaaaa

SEQ ID NO: 27665 - DNA, 1063 bp, Homo sapiens
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcgatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagacaaaaaaaaaaaaaaaaaa

SEQ ID NO: 27666 - DNA, 1362 bp, Homo sapiens
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagacaaaaaaaaaaaaaaaaaa

SEQ ID NO: 27667 - DNA, 1580 bp, Homo sapiens
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacaagggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagacaaaaaaaaaaaaaaaaaa

SEQ ID NO: 27668 - DNA, 1158 bp, Homo sapiens
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagacaaaaaaaaaaaaaaaaaa

SEQ ID NO: 27669 - DNA, 923 bp, Homo sapiens
gctcaggcagagtcctgcccctgcacccactcccccattcccggccccaggccatgccccaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaaaaaaaaaaaaaaaaaaaaaa

SEQ ID NO: 27670 - DNA, 889 bp, Homo sapiens
gtggccgatagctggtcctctttctccaacacctagcctgagacttggcggcgcggctgctatcctgaactagcttggtaagtgttgtgtcccgaaccagcgtagagagacctcggaccagccgccttgatgacagcatccgcgtcctccttttcatcatctcagggtgtccagcagccctccatctacagcttctcccaaataaccagaagcttgtttctcagcaatggtgtggccgccaacgacaaactccttctgtccagcaatcgcatcaccgccattgtcaatgcctcggtggaagtggtcaacgtattcttcgagggcattcagtacataaaggtgcctgttaccgatgctcgtgactcgcgtctctacgacttttttgaccccattgctgatcttatccacaccatcgatatgaggcagggccgtacgctgctgcactgcatggctggagtgagccgttccgcctcactgtgccttgcgtacctcatgaaataccactccatgtcgctgctggacgcccatacatggaccaagtcgcgccgccccatcatccggcccaacaacggcttttgggaacagctcatcaattacgaattcaagctgtttaataacaacaccgtgcgcatgatcaactcgccggtaggtaacatccctgacatctatgagaaggacctacgtacgatgatatcaatgtaagccatcccggccagcccctgacatctgccatcgatcttgcaccaagactgaacttgaacactgacattttgttagtaaagaaaaccggatggtgccttgttaaagggcaagaaaaaagggagggggttggagttttgaacgtagtaagccttaccttaatagaattaaattcatgaaacataaaaaa

SEQ ID NO: 27671 - DNA, 795 bp, Homo sapiens
agcgggctcctgggtggcgagcaggcgcgtgtgtagggacgaagtttcactcttgttgcccaggctggagtgcaatggcacaatctcagctcactgcaacctctgcctcccgggttcaagtgattctcctgcctcagccttccaagtagctgggattacaggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatgtttttgtttgtttcaaatttcaaaaaaaaaaaaaaaaaaaaaaaaaagaaaaaaaaaaaaaaaa

SEQ ID NO: 27672 - DNA, 506 bp, Homo sapiens
cagccctgacgcttccttggggccacttccttctttttttcctagcaacggcgggtagcgtttttgacatcccgggaggctgtgccgccggcctgagcccagagtttcgcggcctccgcgatggcagaggtggaggaaaccttaaagaggatccagagtcataaaggggttattggaactatggttgtaaatgcagaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcaatctaaaaaaaaaaa

SEQ ID NO: 27673 - DNA, 2301 bp, Homo sapiens
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgcaaaaaaaaaaaaaaaaaaaaaaaaaaaaaaaaaaaaaaaaa

SEQ ID NO: 27674 - DNA, 2207 bp, Homo sapiens
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggaggttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgcaaaaaaaaaaaaaaaaaaaaaaaaaaaaaaaaaaaaaaaaa

SEQ ID NO: 27675 - DNA, 5728 bp, Homo sapiens
ctacgatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagcttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccggaccatagtaaatttaaaacaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttaccagaattgaaaagagaaacatatggccagattcaagtctgtgcaaaacagaagctggctcgccatggttcttttaacacagttcaggcttctgagaggatccagaggaaagtgaactcagaaccgagcagcccgtacagagaagaacaaggatcaggtggctactctttagaaattggaagcctggcagctgtctatagacagaaaatagaagacaattcacagggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcaggattaaatggtttcaatgtacttttatctggcagtcaaaccccccctactgtgggcccgtcctcaggtcagctgccgtctttcagtgtcccttgcatggtcttaccatctccacctctgggcccttttcctgttctctattctcctgcaatgccgggcccggtttcttctactcttggtgctctcccaaacacaggacctgtgaatttcagcttgcctggccttggatcaatagcccagcttctcgtcggccccacagctgtggttaatccaaagtcgtccacactcccttctgcagaccctcagcttcagagtcagccctcactaaacctaagtccagtgatgtcaaggtcacacagtgtcgtccaacaacctgagtcccccgtttacgtgggacatccagtctcagtagtaaaattacatcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaattgcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaagaaaa

SEQ ID NO: 27676 - DNA, 4316 bp, Homo sapiens
atgcggaccccttttaaccttggggagactgggtggctggacccccagggcagtgagtgtcttgactatgggagtcaaattaactcgtttagactcggagagccctgccagttgaagtccagctgggaagaaatccaggaccaggaacctttccaaaagttacaattttgcaaaggtggtttccaacggactcagccgcacgcggcccctctgtccctccgggggacaggcgagtgtccctggggcctgcagggcagtcctgctggctgcaaaagagagaatcacgcgacccctagccgggcctcccagggcctccgcgcgtcagtcctcctggccaccgcgtggcgctgtgccttacgttgttgggccgttgggtggaccacgtggtctccgacgcctcaaggcctgctcagcgtgcgcgggcatccggtgggtgcgggaggcccgaggccaggcaggcagggatcccgcagcgaggggctggttactgccaggacggagcgcattgcctcgagccgaccccggggtccgcgagggctcctggggacgaggagtgtggggcacctgccgcggggggcccaggcgctaaaggtggagggaaggaacgcactcgcggcgggggcctggccggggcggacgcagccagcctcacccgcgacggtaggggacttccagggcgagggggcccatctgccctcgggcgccaggaggatgctccagctcctggtgctgaagattgaagatccaggttgcttctgggttattataaaagggtgtagtccctttttagatcatgatgtcgattatcaaaaattaaatagtgccatgaatgacttctacaacagcacgtgtcaagatatagaaataaaacccttaacattggaagaaggacaggtgtgtgtggtctattgtgaggagctaaagtgctggtgcagggccattgtcaaatcaattacgtcttccgcagaccagtacctggcagaatgtttccttgtggactttgccaagaacattccagtcaaatctaaaaacatccgagttgtagtagaatcgtttatgcagcttccctatagagcaaaaaaattcagcctgtactgcacaaagcctgtcacattacacattgacttctgccgagacagtactgacattgtacctgccaagaagtgggacaatgcagctattcagtactttcagaaccttctgaaagcaactacccaggtggaagccagattatgtgctgtggaagaagatacatttgaggtttacctttatgtaactataaaagatgaaaaagtttgtgttaatgatgatcttgttgcaaagaactatgcttgttatatgtcacctacaaagaataaaaaccttgattatttagaaaaaccaagattgaatataaaatcagcaccctccttcaataaactcaatccagcacttacactctggccaatgtttttgcaaggaaaagatgttcaaggaatggaagattcacatggtgtaaattttccggcacaatctctgcaacatacatggtgcaagggtattgtcggtgacctcaggccaacagccacagcacaggacaaagctgtaaaatgtaatatggattcattgagagattcacctaaagacaaatctgaaaagaaacaccattgcatctctttaaaagatacaaataagcgtgttgaatcctcagtgtactggccagcaaaaagaggcataaccatatatgctgatccagatgtaccagaagcaagtgctttaagtcagaagtcaaatgagaaacctcttagattgactgagaagaaagaatatgatgagaagaatagctgtgtgaaattactgcagtttttaaatcctgatcctttgagagctgacggaatctctgatctccagcagttgcagaagctgaagggcctgcagccgcccgtggtagtgctccggaacaagatcaagccctgcttaaccattgactcgtcgccgctgtcagcagacctgaagaaggctcttcaaagaaataagtttccgggccccagccacactgaatcttactcttggcctcccatagcgcgtggctgtgatgtggttgtcatttctcactgtgaaagcaaccctttgctctacctcctaccagtgttgacagttttgcaaacaggagcctgctacaagtcattaccaagtagaaatggacctctcgcagtcatcgtgtgccctgggtggaagaaggcccaatttatttttgaattattgggagaatatagcatgtcctccaggcctcttcatcctgtgctattaacaattgggctccataaagaggaagccaaaaatacaaagcttccaaggggctgtgatgtgattgttacgaccccatacagcctgctgaggcttctcgcctgtcagagcctgctgttcctcaggctctgccacctgatcctggatgaggtagaggtgctattcttggaagccaatgaacagatgtttgctatattagataactttaaaaaaaatattgaagttgaagaaagggaatctgcaccacatcagattgttgcagttggagttcattggaacaaacatatagaacatctcatcaaagagttcatgaatgatccctacattgtgatcacagccatggaagaggctgctctctatggcaatgtccaacaggtagtacatctttgcctagaatgtgaaaaaacttcttctttactccaagctcttgattttattccaagtcaggcacaaaagaccttgatcttcacctgctctgtagctgaaacagaaatagtgtgtaaggtagtagaaagcagttcaatattttgcttgaagatgcataaagaaatgatttttaacttacaaaatgttttagaacagtggaagaagaagttaagttctggctctcaaattatattagccctcacagacgactgcgtcccactcttggccatcaccgatgccacgtgtgtgattcacttcagtttccctgcctcaccaaaagtttttggtggacgcctgtattgcatgtctgatcattttcacgctgaacagggttctcctgcagaacagggagataagaaagccaaatctgtcttgctgctgacggagaaagatgcgagccatgcggtgggcgtcctgcgctacttggagcgagcggacgccaaggtccccgcagagctgtacgagttcaccgcaggagttctggaagccaaagaagataagaaagccggaaggcctctttgtccatatctgaaggcttttggtttttgcaaagacaaaaggatctgtcctgaccgacaccgtattaatccagaaacggacttgcccaggaaactgtccagccaagccctaccttcatttggatacattaaaataatacctttttatattttgaatgcaacaaattactttggccgtatagttgataaacacatggatctttatgcaactctcaatgctgaaatgaatgagtattttaaggattctaataaaacaactgtggaaaaggtggagaagtttggattgtatggattagcagaaaaaacgctttttcacagggttcaggtgttggaagtgaaccaaaaagaagacgcctgggccctggatgacatccttgtagagttcatcgatgaaggcaggacggggctcgtcacaagggaccagctgctgcatctcccagaacatttccacacacttcccccgcaggctgtggagtttattgtctgtagggtgaaacctgctgacaacgaaatagaatggaatccgaaggttactaggtacattcatcataaaattgttggaaaattgcatgatgcaaaagtgatcctggctttgggaaatacagtttggattgatccaatggtgcacattacaaacctttccagtttaaaaacctctgtcattgattataatgttcgagctgaaattttgtccatgggcatgggcattgataatccagaacacatagaacaactgaaaaaattacgcgaagatgctaagataccagcttgtgaagaaagcctaagccagaccccgccgagggtgacagggaccagtcctgctcaagaccaggatcatccatccgaggagcagggggggcaggggacgcctccagcagaagatgctgcttgcctgcagagcccccagcctgaggacacgggtgcagaaggaggggctgagtccaagacgagctcagaaaaccagaagcctggtgggtacttggtattcaaaagatggttaagttcaaatcgttaatgtctggaaaattgctaatgtttagactttctactttgagatgaaatgtagagaagatgacataaactgat

SEQ ID NO: 27677 - DNA, 4316 bp, Homo sapiens; identical to SEQ ID NO: 27676

SEQ ID NO: 27678 - DNA, 1447 bp, Homo sapiens
actttccacacgctgggagggccgttacctcagagatacccgtggccggcatgttggttgaaaaagcttcccggaagggagacgaagagaaaggagaggagcagctcgtgatcatccccggtagcgagtacgcggcgaagtaggcggcggcggagggagcgctgatgaagatggatgtgtcagtgagggccgcgggctgctccgacgacctcagctctggggaggccgacgtagacccaaagctcctggagctcaccgctgacgaggagaagtgccgcagcatccgcaggcagtaccggcagctcatgtactgcgtgcggcagaaccgggaggacatcgtgagctcggcgaacaactccttaaccgaggctctggaggaagccaacgtcctctttgatggcgtgagccgaaccagagaagcagccctcgacgcccggtttcttgttatggcttctgatttgggtaaagaaaaggcaaagcagttaaactcagatatgaacttctttaatcagttagcattttgtgactttctgtttctgttcgtgggtctgaattggatggaaggcgatcctgacaagttgagtgattgtgatgatagcatagctctttccttctggaaggcaatagaaaaggaagcaacatcctggatggtaaaagctgagacattccattttgtttttggttcattcaagctagaacgttctgcaccaaagccccgacttgaacaccagaaaaaagttcgcaagatggaagaaaatggcaacatgcctacaaagttgcagaagttggacctgagtagttatccagaagcgacagaaaaaaacgtagaaaggattttgggattgttgcaaacctactttcgaaagtatcctgatactcctgtgtcctattttgagtttgtgattgatccaaactctttttctcgtactgtggagaatatattttatgtttcttttattgtaagagatggttttgcaagaataaggcttgatgaagacaggctgccaatattagagccgatgaatgttaaccaaatgggtgagggaaatgattccagttgccatggcaggaaacagggagttatatctttgactttacaggagtggaaaaacattgtggcagcttttgaaatttctgaggctatgattacatactcctcatactaaagatttcttagtatagcatcctttttgtgttttttttctgaagttagatggagagtaaaatgtaaactgaagcacatattgtatctcttgtaaagtgaaaaagtattttcaagaacatcagacattgttttactgtgcagcatatttttcttagtaatttataaggtcatgatcttctgttattaaaacaaattcactggcatatttatgggaacgttttattgaatgccctttaagactattaataaaaacaagttttggataccaaaaaaaaaaaaaaa

SEQ ID NO: 27679 - DNA, 5305 bp, Homo sapiens
tccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagatgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgacccttcaggtattgagtaacacctttatcttggtatagaactgatactttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttga

SEQ ID NO: 27680 - DNA, 6075 bp, Homo sapiens
ggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaattttgttttgttttttattttaccttttctttctttttggctagggaaggtgcaggtggcccagcattcagggaggagtcgtaagatcttaagaaaccaatccttgcctcaagcaaaagcatttctgaatctgtgacgcaagaatgtgcagttacaggctggtggcttttaaaccaggagcccggaggaagggtgaaagagaaagcctgtgaaataggcagggccagatcacccaaaactcctcaggactgggatctggcgtttataaataactagtttacagagagaatcacaaacaggataacttagtaccagcagtttttaaccttgacgtgagactaaaacgtgaccgtaggctgttttttagttattgctctcatgagatgatggctgtatttatctgtttatttatacctatttatgtatttatttattgaagtgtgaaattgagcaataggcaggcaccaccgtccccagagcaggtcagcgtctcgagaggcccctggacaattgaggatgcccatcccctcccctttccctgatcttttactgaggggctgtgtgcgcgatccttgcaaattgatgatgttgccatccgtacccaggctgtgtctcataaaagtcggcctggtgccagagaggacctcctttctcccacagaatcccagatcctcaggaaaagccaaaaccgaggcccattgcccggattcgacacaaaagagggtccctgctctgttgcccgagagcagtctgcatcctgggaccagaatgctttcctggaaaaagaagcctttcaggtttccctgggccagcatcttctgatggaaggtgggagccaacacccttctgatggaaggtgggagccaacacccttctgatggaaggtgggagccaacacccttctgatggaaggtgggagccaacacccttctgatggaaggtgggagccaacacccttctgatggaaggcgggattcccgcttctgaaactccccctggagtctcactcccacacatgcccatagctagcattcaacagagaactctgtcttaagcttcaactgtgaaaatgatgacgggcttgtagcacctcagcttctttcctcgcccccttttatctgaatcctatcaattattctgatgctgggacaggtgagaagaaactgtgaagtatatgagcctttgaaagttccctgaagtttctcagttcaggaacattctcattgtatgtggtctccgctgtttgaacagccttctagctaaaaaattccaaagcctttatttgggagtcttagcttgcaagcttgtggaaggatttagcttaacaactgtcactcctgaaaagcaatctctgttccatcaaggttctagttgctggccctgtgtcctcaaagttcattacatcttatcaaggcctgtttgcaaaggggagatcccttttcttaaaaaaggctcaacccaaaagaaaccatttcttaaaaaattttacatagatcagttgtatttctatttagcaaaaatgagtgctctgcttttatttgggaatttcgatgaaaaagcgttcagagtagataatgttcatttatcaaaaatctggtttgggaaataccaaagaggctttgattgaattcccttttgacccgtgtgtaacttcctctggtagttagaccccaggcagctccgaatttgtgaacctgcttcctgatgaattctcccttgttcccccttggctctgccattatttcgttttcagtgtaatttgccaagccgcagttttctgtgctggctgtgcctctagtcgcagctctgtgactgattccctcccgggtgctgagtcccctccccggccaccatcctgcgtgaatatcctgaaattcatgggcttcctcgggggcccgcccgcaggtggtgctgggtgggttccgccaccttctcctggaaggtgagccttttcctggccaagggcagctgccttaacctctgagagtctgcgcttggccttagtcctggagacccagcctccagggactgaaccgtgctgctgttgggagccaagaccggccctttggagccggcagcccaggggtccctgctggatcagagaaatagaagcacccgaagacggttagtggcaattccttgacccggtttgcttccaaatgaaggccatttgtccaccaggcattgaaaagacatgacttacccagtccggcatcggacttgaaaaatcgaaattgacatcactcagctgttacatttcacatccgattcagcccccttttatttccatgtgcttttcgcagccttcctgtgttggatgaaagagaataagaattcagctgacaggaggcctctatcctgtccctccaccccaccctccacctcaatcccctcccatcttccccagacctacctcacctactaggacctgaggcagctccttagcagagacccctggggtttagctgactctgggggtcaggggttcctgtccccaaacttcgcaagacagccctgaagtcacaagtgctttcttttaagtggcattggcaattggcgtgtaatgatggcagtagaatctgaatctcggatcccaggcagggttcacatttccaaacctttttgatttcccctgacctctaatggctggatcctatttttctacaacctttcagtgacatcgttcaggtttctttcttggccatttaaaaaaacaaattttttttttctcacttgtaagtcaccgccagtacctaagttaggctaacggagactttgacaggactggatttttcttccaccagaagagaagccttttccgttggtttggggccacctctttgaccatgaccatgtgatgttccgtttacagtgacttgctttgggggaggggaggctctcttaaccgattcccatgttgtacagtagatggttagaccttttgtatattagtgtgttttaagttattgatttgttttatataaaataatttatttttcaggtgccatttttcattttaactttgtttttacatgggtttgttttcaataaagtctgacactggtgtccaaaagtcaacaataaaatgaatcccattgtgttcttttgaagatgcctatgtaacttttaagctttttaaattattttcagaaaaaaaaaaagaaaagcccttatcagttttccatcagcccattgcctttttattttttttttttaatccttgtgaataaatgttctttagtgttttaggaggaaaaagcaaacctagattttgataacccagaagacttcagattaataaagaagctttgaaagaagaccatttttcaaaattttagtgaagtgtgaatattttttgtcaatggctttctcaaagagaatgaaacttttgcaccattttcagagtttttatagagatgccaaattgatatatttacatgtaatggaaacatgaaaaagttttattaaacaattgttcatagctgtgtagacattttaattcagtttccaaagctctcaaaaaatcgtatttttgaagtacggagtgatgcggtttggggcgtggcttacagttccaacgactcaattgtcccgatactcagttctttctacaggtatcaggttcgtgttaaacgctgtatgttaactatgactggaattctgtgatattttggtaataaatgaagtgggatcattgcgaaaaaaaaaaaaaaaaaa

SEQ ID NO: 27681 - DNA, 3034 bp, Homo sapiens
tttcttgttaaacaaacacctaatttatttcttggaggttttgttcagctgtcctaatttatgactttacattccttctggtgctaaactgctcaagtagcctcttgtatcaagtgtgacctgattccttaagaattttacttaatgagaacctctaagctagaaactcttgctaggtgtttcatgcaccttattttctttaatcattacaacaactctaagattgggttctctccaccttataaatgatgactgttttagagaggttaaggttgcttaaaattggtgagttagtgaggggtagagccacgaatggatttctggtcgctgcctccatcgtcagggcaagcttttcccacgactccagcgcttccatttgtcagtccccaggctagaaagccacagtgctaatttagtatttatcaagcgtttgtagtgtcctgggatctggcacttcgatgagaaagctgtgacggccccaacttctaacagcgagtggtaaggaggacgagggacacaggagggaggagactctccccaaagcttagcaccaacagaagtggtcccccgcaggttgctctgcgagcgccacctcttccctccaaccgaggagaaagtggcgcgcctttgaggagtccgaggtcccggcccaggcggcagcttgggtcctggcgggttccggacgggcgcctcagggacctggaagcaaccgcaccgaacgcgacggagagcggcgagacgactccaggaggcgcccgagctacatcccccggccacaccaaacccgggtttgctggcagacgcggctcacgacaccccttagggtcgcagcccctcccccggaagtgacgtgtagcgactacggcgtctgggagggacccaggagcagtcggggggtttgagagtggcggcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacagacacccatcatactgactccaagccccttgctctccagtatccacttctggagtactctcagtcctgttgctcccctaagtccagccagactgcaaggtgctaacacacttttccagtttccttctgtactgaacagtcatgggccattcactctgtctgggctggatggaccttccacccctggcccattttccccagacctacagaagacataacctatgcacttgtggaatgagagaaccgaggaacgaagaaacagacattcaacatgattgcatttgaagtgagcaattgatagttctacaatgctgataatagactattgtgatttttgccattccccattgaaaacatctttttaggattctctttgaataggactcaagttggactatatgtataaaaatgccttaattggagtctaaactccacctccctctgtcttttccttttctttttctttccttccttccttttcttttctcctttaaaaatattttgagctttgtgctgaagaagtttttggtgggctttagtgactgtgctttgcaaaagcaattaagaacaaagttactccttctggctattgggaccctttggccaggaaaaattatgcttagaatctattatttaaagaaatatttgtgaaatgaaaaaaaaaaaaaaaaaaaaaaaaaaaaaaaaaaaaaaaaaaaaaaaaaaa

SEQ ID NO: 27682 - DNA, 3077 bp, Homo sapiens
tttcttgttaaacaaacacctaatttatttcttggaggttttgttcagctgtcctaatttatgactttacattccttctggtgctaaactgctcaagtagcctcttgtatcaagtgtgacctgattccttaagaattttacttaatgagaacctctaagctagaaactcttgctaggtgtttcatgcaccttattttctttaatcattacaacaactctaagattgggttctctccaccttataaatgatgactgttttagagaggttaaggttgcttaaaattggtgagttagtgaggggtagagccacgaatggatttctggtcgctgcctccatcgtcagggcaagcttttcccacgactccagcgcttccatttgtcagtccccaggctagaaagccacagtgctaatttagtatttatcaagcgtttgtagtgtcctgggatctggcacttcgatgagaaagctgtgacggccccaacttctaacagcgagtggtaaggaggacgagggacacaggagggaggagactctccccaaagcttagcaccaacagaagtggtcccccgcaggttgctctgcgagcgccacctcttccctccaaccgaggagaaagtggcgcgcctttgaggagtccgaggtcccggcccaggcggcagcttgggtcctggcgggttccggacgggcgcctcagggacctggaagcaaccgcaccgaacgcgacggagagcggcgagacgactccaggaggcgcccgagctacatcccccggccacaccaaacccgggtttgctggcagacgcggctcacgacaccccttagggtcgcagcccctcccccggaagtgacgtgtagcgactacggcgtctgggagggacccaggagcagtcggggggtttgagagtggcggcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacaggtagcttgctcgctctttatggtgtcaccattgctttcatttatttgcccttttaagcaaatccagaatttatacactcaagtttgctttctgttacttaggtttgtcttagaaaggttatgtgtgactgtcatgtgaaagttaccccatttctcatcttaattaggattgctaaaatagaaagtttggagtattttcttaaaaaattcattgttctacaagtaaataaatattttgatttttctatttcctcctaaagaaagtacacacactctctcgctctctctcggtcttataaaactcgttggtgtcttataaaacaaacagtgataatctcaagttagaaaacagtaggtcctgagaaccataagaaaaatgactggtgtgatgttgagtaacaagttggtacagttactttagctatttattaacttgctcatctcatagaacattttagtagatttttcacacacctcattattaaaaaaaaacaaacatgctggtgtcttggttacccattattcctctgtacctgaattcaggttggtttttctatttggaaaagactttataaatgttggcttaaaaagaggttgagcaccagaatctcagaatttaccaccaaagaactcatccatgtaaccaaaaaccacttgtacccccaaaaactattgaaataaaaatttaaaaaattttaaaaaaaaaaaaaaaaaaaaaaaaaaaaaaaaaaaaaaaaaaaaaaaaaaa

SEQ ID NO: 27683 - DNA, 4058 bp, Homo sapiens
ggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctagtgtcctttttgtacactaaacaggtgaatgctgacttttttcattctccaataaatttcactgaactgaaaaaaaaaaaaaaaaaaaaaaaaaaaaaaaaaaaaaaaaaaaaaaaaaaaa

SEQ ID NO: 27684 - DNA, 2259 bp, Homo sapiens
ttcctaagaagcactttctgccagcattgttcaacaaaggcagcctcagaagcgggtgaatgcctcatgataaagtatgtgacaaagactgtggctactgctggggaagctgccggaggaccaggccagtgggagctgagctagattatctctgaagcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcaccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggtgagcggcccaggttctcccagatccacagcatcctgagcaagatggtgcaggacccagagccccccaagtgtgccctgactacctgtcccaggcctcccaccccactagcggactgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctatgccattgagtgtaagatgtcctaccaagaaagaaacatcacagccaactatgttgtgccatccaactgaaagatgcatcccagtttcagagatgttaacatgtacgtcttcaataaatgagatgccgcgcatc

SEQ ID NO: 27685 - DNA, 2774 bp, Homo sapiens
gggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagcccccaccttctgggcctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaat

SEQ ID NO: 27686 - DNA, 2031 bp, Homo sapiens
gcccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgtgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtctcc

SEQ ID NO: 27687 - DNA, 2249 bp, Homo sapiens
gcccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagataaaatgaagcttcttatccaagatgctcaaggaaataaaatgtgagtcaaggattttatatccagccaaactgatttcagatacaaaaaggacggataaattgtcaacaacacaagaattcagagactgttgttctcattagccattccttaggaatcaaccagagaatgaaatcattcaaccagaatgacaagagagacagcaacttaaggattgacgcatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgtgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtctcc

SEQ ID NO: 27688 - DNA, 925 bp, Homo sapiens
gcccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtatttttattttatttcaaacggcaactactttgagtaaacgattcaataaaaagaaacgttactaacagtgtattctttgtaagtgacatgactaatgtactttgtgctggttgttgagactcagcagggaaataaagatccttctgtgcattattcttataaaactgaaccattgaaaacacatttatatgaacaatgatcattggggaagctcaaacaatatgaaaaatagttctaactcaaaaccttgtgttatttctacattaaaaagactaatgcaactcacaaaaaaaaaaaaaaaaaaaaaaaaaaaaaa

SEQ ID NO: 27689 - DNA, 5640 bp, Homo sapiens
atggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtataatagattgtaatgaaaacacaaggaaaaaatcccagaaagaaacggaaggtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgaggcacaagtcctcttccagcaggtcaggtgcctgtaacattacaacctcaaaagcaggttaaagaaaataagacccaaccgccagtagcctatcaatactggcctccggctgaacttcagtatcggccacccccagaaagtcagtatggatatccaggaatgcccccagcaccacagggcagggcgccataccctcagccgcccactaggagacttaatcctacggcaccacctagtagacagggtagtaaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaaagctaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgctgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaagaaaatgttataattgtggtcaaattggtcacttaaaaaagaattgcccagtcttaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccccgccacaagcggcagtgcagcaagtagatttatgtactatacaagcagtctctctgcttccaggggagcccccacaaaaaacccccacaggggtatatggacccctgcctaaggggactgtaggactaatcttgggacgatcaagtctaaatctaaaaggagttcaaattcatactagtgtggttgattcagactataaaggcgaaattcaattggttattagctcttcaattccttggagtgccagtccaagagacaggattgctcaattattactcctgccatacattaagggtggaaatagtgaaataaaaagaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtacggagattttacattgcttagggccagataatcaagaaagtactgttcagccaatgattacttcaattcctcttaatctgtggggtcgagatttattacaacaatggggtgcggaaatcaccatgcccgctccatcatatagccccacgagtcaaaaaatcatgaccaagatgggatatataccaggaaagggactagggaaaaatgaagatggcattaaaattccagttgaggctaaaataaatcaagaaagagaaggaatagggaatccttgcctaggggcggccactgtagagcctcctaaacccataccattaacttggaaaacagaaaaaccagtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggctgtaaacgccgtaattcaacccatggggcctctccaacccgggttgccctctccggccatgatcccaaaagattggcctttaattataattgatctaaaggattgcttttttaccatccctctggcagagcaggattgcgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattgtattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataataaaattatgtgggaatgacccagacaaaatagttgtccctttaaccaaggaacaagttagacaagcctttatcaattctggtgcatggaagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacaggaccgaaagaacgagtaatcaaaactccatatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattacacatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcacgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcagagatgcaaagaaaagcacctccgcggagacggagacatcgcaatcgagcaccgttgactcacaagatgaacaaaatggtgacgtcagaagaacagatgaagttgccatccaccaagaaggcagagccgccaacttgggcacaactaaagaagctgacgcagttagctacaaaatatctagagaacacaaaggtgacacaaaccccagagagtatgctgcttgcagccttgatgattgtatcaatggtggtaagtctccctatgcctgcaggagcagctgcagctaa

SEQ ID NO: 27690 - DNA, 2430 bp, Homo sapiens
gctagcgtctgccgcggctccgagggggtggggctgctgggaatggctgtgcccccttcggcccctcagcagcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctgggtcctagctgtgtgtcttccacaatgactgcatccctccagtgctgtagagtcggaaacaggcatggggagattgccaggctgaccctctctggtctgtttccaggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccgg

SEQ ID NO: 27691 - DNA, 688 bp, Homo sapiens
ctgccatgccgacgcagaccccactctgcacgccagcccccctgcacccaccatggccacagttcagcagctagaaggaagatggcgcctggtggacaacaaaggctttgatgaatacatgaaggagctaggagtgggaatagctttgtgaaaaatgggcgcaatggccaagccagattgtatcatcacttgtgatagcaaaaacctcaccataaaaactgagagcactttgaaaacaacacagttttctggtaccctgggagagaagtttgaagaaaacacagctgatggcagaagaactcagactgtttgcaactttacagatggtgcattggttcagcatcaggagtgggatgggaaggaaagcacaataacaagaaaactgaaagatgggaaattagtggtggagcgtgtcatgaaccatgtcgcctgtactcggatctatgaaaaagcacaataaagattccatcatcactttggacaggagttaaccaagagaatgaccaagctcagttcaatgaacaaatctccatactgtttctttcttttttttttcattactgtgttcaattatctttatcacaaacattttacatgcagctatttcaaagtgtgttggattcattaggatcatccctttggttaataaataaatgagtttctgctaaaaaaaaaaaaaaaaaaaaga

SEQ ID NO: 27692 - DNA, 2697 bp, Homo sapiens
agtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggaaaaggagaaggaatggcaacgaagaagacaaccatcttcccccccagaccaaaagaagtagcagaaaccctgtctttcaggattcctgggacacagagtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttattcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagattcttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcaccttttacaccttctagtagctcaagctagtaaaaccttgtacttctctattgcgccgccattaaaagcagcattagtgc

SEQ ID NO: 27693 - DNA, 773 bp, Homo sapiens
gacatcatagtatatccgtgagtcaagcggctgtgggtttttggctcttgcatctgctatagttctgtctcgggtgccatttgctaactctgttctctgtgtagctgcttttggcagctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatctggaggaacatgaggctgtttgtgtcaacaggagcgctgtggaagaagaggacaccgagaaccctctgaaagtcagtcctcctagttcagagcagaacgatgacacccagcagactttttttcctcaaaaggttgtttgtgaaaatgacacgaaagagtcagcaagagagaccagtccccagaagatcctcagaccaggacagtaaactgccagctgaggaaggagcacacgcctcatcaatgcatggaagaacgtgcaatgcatcagaataaaagacatgcaaagtaaactaaaaaaa

SEQ ID NO: 27694 - DNA, 842 bp, Homo sapiens
gacatcatagtatatccgtgagtcaagcggctgtgggtttttggctcttgcatctgctatagttctgtctcgggtgccatttgctaactctgttctctgtgtagctgcttttggcagctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatctggaggaacatgaggctgtttgtgtcaacaggagcgctgtggaagaagaggacaccgagaaccctctgaaagtcagtcctcctagttcagagcagaacgatgacacccagcaggtctcaccctgccttcccagccccgatatctggaatgtcgatggcgctaattgccagcatgtgtttgtccttaagactttttttcctcaaaaggttgtttgtgaaaatgacacgaaagagtcagcaagagagaccagtccccagaagatcctcagaccaggacagtaaactgccagctgaggaaggagcacacgcctcatcaatgcatggaagaacgtgcaatgcatcagaataaaagacatgcaaagtaaacta

SEQ ID NO: 27695 - DNA, 687 bp, Homo sapiens
ctgaggcttcgcaaagcaggagccctccgtagcagggcttcggtgtcggggctccgaggctccggcctgacttctccacggggtacacaggaacgtctccggacgccaggacctgaaatgggccgactaggatgacgaaaccacaggcagagtccggggaagcagcgcggcatcccatcttcaggcctgcccggatggtgttcgggatcaagatgaccacactccagccaaggataaaagccccacaggagctcactgtcctgcaggagaggagcaggcccacgtccaagaagatggctgtatgttttcacggctcttctctgagaagtgaagccacaccacgatacagtcttgaagaggaagccgggaatgggagatggcaacaagccctgtcatggtggcctctctgaacaagttacccttttggcacccctccccttatgcccgtggcggtggcacagtgctgtatcctgcctgggctctggcccctgctctgtcctccctcttactctgtctcccttgtttctgaggggcctagatgcttctaggtctggctgaatgtcttcaaaaaagatcacttcccagtccatcagggagacagttggtggaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27696 - DNA, 2054 bp, Homo sapiens
gtcgagagcgggagaagtcctgtagggagatgggcagttaccttctctccgtctctctctcggggactctatttgtggctggtggagctgtcttaaacgaagagaaccatgagcaatgaatcttgtttaccttattacacagcccacagctactcttcaatgagtgcgttcaaaacctccatgggggacctgcaacgacaattgtacaacagaggagagtacaacattttcaagtatgcaccaatgttcgagagtaattttattcagataaacaaaaagggagaggtgattgatgtacacaaccgtgtccgaatggtgacagtgggcatcgtctgcaccagccccatcctcccactgcctgacgtcatggttctggcccaaccaactaaaatctgtgaacagcatgtcagatggggccggtttgccaaggggagaggtcgcaggcccgtcaagactctagagctcacgagactgcttcccttgaaatttgtgaagatctccatccacgatcatgagaaacagcagctgcgcctgaaactcgccactggccgtactttttatctgcagttgtgtccctcttctgacacacgggaagatctcttttgctattgggaaaaacttgtctatctcctgaggccaccagtagagagttactgcagtaccccaacacttctatctggggacgcaccacccgaagacaacaaaagcctagtggctgcagagctccacagagaaggggatcagagtgagactgggctctacaagccttgtgatgtatctgcagccacctcttctgcttatgctgggggagagggaatccaacatgcctcccacggaacggctagtgcggcttctccatccacgagcactccaggggctgctgaaggaggagcagcaaggacagcaggtggcatggcagtggcaggaacagcaacaggacctagaacagatgtggcaatagcaggggcagcaatgagtcctgcaacaggtgctatgagcatagcaacaaccaaatctgcaggcccaggccaagtgaccacagcgctggcgggagcagctatcaaaaatccaggagaaaatgaatccagcaagtccatggcaggtgctgccaacatatcctcagagggtattagcttggccttggtgggtgctgcaagcacctccttggaaggtacttccacctcgatggcgggggccgccagtctctcccaagacagcagcttgagtgcggcgtttgcaggcagtattacgaccagcaagtgtgcagcagaaagaactgaaggaccagcagtgggacccctcatctccaccttgcaaagcgaaggctacatgagtgaacgagatggaagccagaaagtttcccagcccagtgctgaagtctggaatgaaaacaaggaaagaagagaaaagaaggacagacatcccagtaggaaaagttctcatcaccgcaaggcaggtgaaagtcaccgcaggagagcgggggacaagaatcagaaagcgtcttcccaccggtccgcatctggccataaaaacacgagagatgacaaaaaagaaaaagggtacagcaacgtaaggggcaagcgacatggctcctctcgcaagagctccacccacagctccaccaaaaaggagtcgagaacaactcaggaactggggaagaaccaatctgcatctagcacaggagctttacaaaagaaagccagtaagatcagctcttttttaaggagcctcagggccactcctggttcaaaaacaagggtcacatcacatgacagagaggtagatatcgtggctaagacggtggagaagcaaaacatagaggccaaagtggagaaagcccagggtggccaggagctggagatgatcagtggcactatgacatccgagaagacggagatgatcgtctttgaaaccaaatccatttaaagaggagccagggctacaaccgcccagggatctggaagtatccctagaggagcccatcccagctttctttactgcagttcaaataataaaggaaatcgtacaactccaaaagaaaaaaaaaaaaaaaa

SEQ ID NO: 27697 - DNA, 1988 bp, Homo sapiens
ggggagtgcctgtgtggctgagggacacgtccaagctgcagtcggctctgtggttgtggacacctggcagaaccatgccttctctagtctgggtcatccaaacacacgtggggtgcaggggccaggtggagccctcttgtcgtttttgttatctaacggtaattacggagtccagaaagagaattggaaatgccggcagtttaattaaagctgaatggcaggagaggggcatttggaggctccctccctgccttcactccccgtcctgccgcccaggcaggatgtcagatgaggagacgttgagctcatcaaacacccaatgagaagtcttacaacatcagaagctgtctgccaatgcgcctgcgacagcttatagaaactgctgccgcctcgaatcaacctctctccccaggcattgcacgtcagtaggtaaccaggtcattgctgtggtcatggacctcttcactgatggtgatatctttcaagacattgtggatgctgcctgtaagcgccgggtcccagtgtacatcatcctggacgaggcaggagtgaagtatttcctggagatgtgtcaggacctgcagctcactgacttccggattcggaacatccgtgtccgctctgtgacaggcgtcggcttctacatgcccatggggaggatcaaggggaccctgtcatcaaggttcctgatggtggacggtgacaaagtggccactggatcttacaggttcacctggagttcctcccatgtggacagaaacctcctcctgctcctgacaggacagaacgtagagccctttgacacggagttccgggagctgtacgccatctccgaggaggtggacttgtaccggcagctgagcctggcgggcagggttggcctccattactcctccactgtggctcgaaagcttatcaaccccaagtacgccttggtgtcaggctgccgccacccgcctggggagatgatgcgctgggctgcccggcaacagtgggaggcgggcggcaacccggaggggcaggaggagggcgccagcggtggcgagtcggcctggcgcctggagagcttcctgaaagacctggttacggtggagcaggtgctgccccccgtggagcccatccccttgggagagctgagccagaaggatggcaggatggtctctcacatgcacagagacctgaagcccaaatcccgagaggcacccagccgaaacggcatgggagaagcggcccggggggaggccgcccccgccaggcgcttcagcagcaggctcttcagtcgccgagccaagaggcctgcggcgcccaatggcatggccagctctgtctccaccgagacctctgaagtggagtttctgacggggaagaggcccaacgagaattccagtgctgacatctcaggtaaaacaagtcccagttctgccaagcctagcaactgtgtgatttcctgagctgcgggatggtggtgggcaggacgtgtggatgcctgcctgccctgccctgtgctgtggagagcgcaggtcgcacactgcaccagtttgcacatcagacgccaactggccttctgccctgcagcctccgtcctggcctcagggacgctggatcccaaatgagagggtccgaagcatctcagtcacacgcctccaccggactgtcggtggctgggcaggggtcagtgccacggcctccttgtttacatgaagtggaagcttgaccagtgtctgctcgcctttgtgccccaccccctccgctgattgccagatggggtgagggcccattctttaaacctttatggggtggggtgtctggggcagctgcagtggcttctcctttcccaggcttcctggtgcttctggttccccacgccactccccacccaagagattggtggaataaaagggaagagggcagggccctgagcctggaaaaaaaaaaaaaaaaaaaaaaaaaaaaaaaaaaaaaaaaaaaaaaaaaaaaaaaaaaaaaaa

SEQ ID NO: 27698 - DNA, 4695 bp, Homo sapiens
gggggagggaaacggagcagtaacaagtatcccagagggtgctgctgaggcgacgatggccgaggggcccgaggaagcccgaggccaccctcccgggcaggacgatggcgggggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtactattaatagcttgcgaaatattagcaattttcccattatggactatctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctgtgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactggttcaatggacatgtccctaagataaaccagaattggcagttaatttaggcgtctagaaaatctcagttcccaccagtaaaattatcctgagtagctaatgcaccttgagaaaaatctggcatactgaataagtaacattaacttgggagccaagagctgggtaagccttacctttagactactctgtgactacagaaataaagccagcacttttggaactaataagccttcacttgtcagtatcataaagagtattgcccaactgaactttgctcccactggtttaatagttacttatttctgcctaagcactcaccttccgattttacccaagtatatatataggatagaaaaaaatgcattatatttgagagctcacttcgcccgaattacaaaatgagtgtttttagattcaagtgacggtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcgatgcaaaaaaaaaaaaaaaaaaaaaaaa

SEQ ID NO: 27699 - DNA, 2744 bp, Homo sapiens
agaatgcgagaaagtgaagtcaaattcggacttgtaggcgatcagggctgaagacgctgattagagagaaaacagagggtgatggtggctgcacgtggggaatgggtgacatctcccagggggaatgagcacaaggcccagatcggaaaccccaaactcagattttaaggtttggacaagaagtacctgaggagtggaggagtgagaaagaagtgccagagagcctgaggaggaaaatcagcagactggcattatgaagaatgttgtcagaagtagggagtaggcactagtcacctaagataaggagctggattctgcccaaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatatgctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaac

SEQ ID NO: 27700 - DNA, 3727 bp, Homo sapiens
ctgctttcaaggtgtctagatacagagtgaagaatgtcacagtaggaagtgcactggactaggggagtcaggagacccgggttcttgtgttggcaccatcactcatgagctacgaggtgacttcaggctgccattggacctgtcaagtgcctgagtcatgtgataatgggctacattgcgcagggcccctgggccatctccacaggagatgccagaggacgagtgcccacttgctggtcttcacagagcacgctgaaatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcaaaaaaaaaaaaaaaaaaaaaaaaaa

SEQ ID NO: 27701 - DNA, 3540 bp, Homo sapiens
cagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggca

SEQ ID NO: 27702 - DNA, 2452 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27703 - DNA, 2502 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27704 - DNA, 2529 bp, Homo sapiens
gacggaggggcagtgcctactacgcaggcgcacgctgcgggcgacaggaccaggcagcaacattgccacgcggatccgcgccggccaatcagcatggccaggggcggggcttccctgaggcgcgccgggaggcggcggcccacttccggcaataaccgcctggtcgccgtcaggtgcgggcccaggtggccggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaggaaaaaggaccattttagaaatgacacaaatactcaaagtttttatcgtgaaaaatggatctatgtccataaagaaagcacaaaggaaaggcatggctattgcaccttgggagaagcctttaatcggttagacttctcaagtgcaattcaagatatccgaaggttcaattatgtggtcaaactgttgcagctaattgcaaaatcccagttaacttcattgagtggcgtggcacagaagaattacttcaacattttggataaaatcgttcaaaaggttcttgatgaccaccacaatcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggactaccatcttgctttactattcaaggactcaggacacccctgcacggcggccgaccctgacagctgcttcacgcctgtgtctccgcagcacttcatcgacctcttcaagttttaagggctgcccctgccatccctattggagattgtgaatcctgctgtctgtgcagggctcatagtgagtgttctgtgaggtgggtggagactcctcggaagcccctgcttccagaaagcctgggaagaactgcccttctgcaaaggggggactgcatggttgcattttcatcactgaaagtcagaggccaaggaaatcatttctacttctttaaaaactccttctaagcatattaaaatgtgaaattttgcgtactctctctctctatatatatagttcaaaaatactttaggtggtcagctccacattctttgttgacgtgacactaacggccaataatatgcttcttaattatcaaattatagtttcccaattgggaaactaattgggggtgggttacaaaacatttgatccttgtaaatacattgtacagaatatttattttttctcaaaatgcattttaactactacattggctgtgcccaaatgagtcctctttgaatagaaagtgaacccagggcaatgacagccattcttgtcttagggattatggatcggggtatgaagtgtgcacacgcagcccaacaacgggcagtggtctctgtgctcctaggcatccagcacaggttctggcagggcacccctgctggggttgggggctggtctgtgcataatcctggactgtgatgggaacagcccagtgcagtctaaacttcaattgtgttgaaactactttaatagacaaagtaataaatcatgtttatctattgatttaaacttcatcagttttgcatcctactgagaaatgttagtgattttgatacttaaatccttaaaagattgcttcgtttttaaaataacgcatgtccattttagaaaattagaaaatcagtcccaccacccaaagattattgtgcatgctgaaaagagtatgaaaaatcccctcagcaggcataggatagaaacgtattgttgtatatttccatttttgaatagggtcaaggagcccaagcaaatcatttctactttttcctttaagcataataataaaagtatacttttatggcgttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27705 - DNA, 2908 bp, Homo sapiens
agcggatcgttacccacccgcccgccatagctcctcgggggagtcagtgccaggctgcagcacacgctgccttttcaggaacccgaatttgggaagtttactcatgtctaagtccagctggagaaaacaaggatattaagataactattttctggagggctgaaggaaattcaaaatgatttagaccttctcaagtgttaggaataatccctgcggcatgcaccctgtgtacccttcgactttgagcaatcatgatgctgctgcacctttcaattaattgtgcaaactaaagttttcctctttaagtggcattattttggcatgagttttaaagacaaagatgagagaatttcttgtttggaagcctacgtaactttgacatctaagagctcaagatttactgatgaaacagagattttgaagatgtcgcaaaggcactcaggtcaagctggcactgaagcaggaaatggggcggactctcctccaattgtcaactccaagtactccaccttcagagatttttgttccacatcttcatttcaagatagtggctacaatgagttaaaatcttgtagcttggataatatagataaagaatatcttggaaagaaagaaaaaggcccaacattactctatgagcaccctgaaacttcaggcctgggcttaacacatcctttagaatctcccactcaaaaaaagaaatgtatcttgcctagaaaggaaaaggataaaaccccagaactttgtgaaacacctaaaatcagtgggaaaaaatgtttacctcgcagaaggttgaatgtatctttcgctcttctaaaaggggactttgaatcacaaaatagttctttagaaagtagtataagccaagttatcaacttagaaaaaaatattccaagcagtgcttcaggtttttccagggcaaataattttagccctttagttactagcactttaaaaacagaagaagtgacttcatgcagtcaaaaattgaggcttaatttttctcagcaaaagacttccacaattgatgattccaaagatgattgtagcctatttgaagttgaatgtatatctccaattcagggcaataattttaaagactctatcacacatgactttagtgatagcagtttatgcattaatgatgagaatgcatgtccagagctcctgggctcctctgttagtggaacaacttgtggaacagatgaggacatatttgtgactccgataagtaatcttgtggcaaacattagatttaacgcaagtcaaatactttctccttcacctgaagtgagaggcagtatttcaacgcctgaagacagtggttttaactcacttagcttggagaaatcagaagattccctgtctgaccaggagggttcttttcaagaactactgcagaaacataaggggactcccaaagttggggacaccataagaaagacaagacatcttggaaggtcgagaagactgtccacccttcgggaacaaagctcgcagtcagagacagaagaggaaaagcagattgtccaccctgactctgaaaaaagagcagcagctgcttctgccatctcagagggtcagctgagtagtgatgagagtggggatttgacctttagcttaaagaatttatcaaagaccccagccttgcaattggtacatgagctgttcatgaaaagcaagaggaaaagattacaggaaatagtggacatgaattcttagagcaaggggatggggagaaaatagctgtactgcagtgtatacttgcaggactgattggcaagaaaatgggtatagaaaaactggacatcttaacagaattaaaatatagaaatttaaagcatattcttgctatggttttagagtccttgaccgcagagagcctatgcagtgtttggaaagtaagcagaaattggcgtgaaattgttgttcaagataaaaatgcaaatcggaggaggaaattttatatcacacaactgaaaacagattctgagggggctgtattaaatgtcgaggatgctgccactcggctccagcttttaaatcgctcagctttaagatctgtgcaggcacaggctaggatacctggttctcagagagagcaagggtcaacattatctccctggggagaagttttgacacctctagcaagctcttctgttactcacttaagtagtaaacaggaagaatatgttaaggttgccaaaacactttttactgatgaagcattaaaaccttgcccaaggtgccagtcccctgctaagtaccagccatataagaaaaggggactgtgtagcagaacagcctgtggttttgacttttgtgtgttatgtctgtgtgcttatcatgggtctgaagaatgtagtagaggagcagcaaagccaagaaatagaaaagatgctctcccaggaagtgcccagagtaagcggaatttaaaacgcctctgaagagactaaatatagaactcccccatgcagtgttctatttatctgacttaaaattatgaatattttgaatacatgcaaatcttcccattaatgacaggtgatgattaatttcctattttgtatatattataatcgatgtcattgtatgttttctttaaagttgttttgaaaaaattttattttactatgtcattttacccattttaataacttggtattttaaataaagaattttcattgttgttatatgtatgtactttattgttttatgtaacattttaaatttgtgcatttcatcactcttgacatgttcttcaatccttttttaaaaaaatagtttttcagataatattaaagattttgaactctagacagatggccttatagatttggaaaatgagtacttgactgaaatgaaatataaataaaatattttcagaagtccaaaaaaaaaaaaaaaa

SEQ ID NO: 27706 - DNA, 1758 bp, Homo sapiens
ggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcgattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattaca

SEQ ID NO: 27707 - DNA, 2153 bp, Homo sapiens
cgaccccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattaca

SEQ ID NO: 27708 - DNA, 2583 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccagggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggccatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacaaaaaaaaaaaaaaaaaaaaaaaaa

SEQ ID NO: 27709 - DNA, 2931 bp, Homo sapiens
attatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggagtaaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatgcagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagatagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttccaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtg

SEQ ID NO: 27710 - DNA, 1902 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagataccaaggtataaaggacaaggtaagaagaagacaagcgggcagaaggctggtgacaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctaaaaaaaaaaaaaaaaaa

SEQ ID NO: 27711 - DNA, 1842 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctaaaaaaaaaaaaaaaaaa

SEQ ID NO: 27712 - DNA, 3246 bp, Homo sapiens
ccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggtaaggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatgaaaaaagaaaagcaaaggaagccttggagtcggaaaagagaaaagttcaggatctggagaaccatttaacccaacagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagtagatgggagcttccagcccctgcctcgcagacagatggtgaggatgaaagaatgcaggcatccctcgctatctgctgtccactctcgctgtcgtcatacctcaggagccaagtgcttttggatggtgagggtgcttgtcccgtctctgaagcacctgcccagggcctggcaccagccggcggacactgccttccccatgctgcccatgacccatgctgcccgtgacccatgcaggtggtctcctgggaaagtgtagaggagcacgaactgagaaacgcaaaagaatcgacaccttgcaactgtgccttcaaagagaaagacaggcagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtc

SEQ ID NO: 27713 - DNA, 3577 bp, Homo sapiens
ccatgtaagaagtgcttttcgcctcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagatgggagcttccagcccctgcctcgcagacagatggtgaggatgaaagaatgcaggcatccctcgctatctgctgtccactctcgctgtcgtcatacctcaggagccaagtgcttttggatggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgtt

SEQ ID NO: 27714 - DNA, 4539 bp, Homo sapiens
ccatgtaagaagtgcttttcgcctcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagatgaggaaactgcgcctcagagagttaagaggcgcccaagtgcacacagcggctggtaaggacagctgggacctgaccccagatccctctgaccctggttctcctgctgtctgcagggttggccgaaagtgtagaggagcacgaactgagaaacgcaaaagaatcgacaccttgcaactgtgccttcaaagagaaagacaggcaggccctgccccacctgcctgcagtttgaacggatgacctaagagacaagcacgcgtccagccccgtctgtccattaagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtctttaaaaaaaaaaaaaaatggctgggcctgtaatcccagctactcgggaggctgagacaggagaatcacttcaacccgggaggtgatgattgcagggagccaagatcacacaactgcactctagcctgagtgacagagcaagactcc

SEQ ID NO: 27715 - DNA, 356 bp, Homo sapiens
ccatgcaggtggtctcctggatgaggaaactgcgcctcagagagttaagaggcgcccaagtgcacacagcggctgagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgtt

SEQ ID NO: 27716 - DNA, 4203 bp, Homo sapiens
ccatgtaagaagtgcttttcgcctcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtctttaaaaaaaaaaaaaaatggctgggcctgtaatcccagctactcgggaggctgagacaggagaatcacttcaacccgggaggtgatgattgcagggagccaagatcacacaactgcactctagcctgagtgacagagcaagactcc

SEQ ID NO: 27717 - DNA, 3246 bp, Homo sapiens
ccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaagaaaagctgcgggagcatctggcagagaaggagaagctgaacgaggagaggctagagcaagaggagaagctcaaagccaaaatcaggcaactgacggaagagaaggcggtaaggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatgaaaaaagaaaagcaaaggaagccttggagtcggaaaagagaaaagttcaggatctggagaaccatttaacccaacagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccgttgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagtagatgggagcttccagcccctgcctcgcagacagatggtgaggatgaaagaatgcaggcatccctcgctatctgctgtccactctcgctgtcgtcatacctcaggagccaagtgcttttggatggtgagggtgcttgtcccgtctctgaagcacctgcccagggcctggcaccagccggcggacactgccttccccatgctgcccatgacccatgctgcccgtgacccatgcaggtggtctcctgggaaagtgtagaggagcacgaactgagaaacgcaaaagaatcgacaccttgcaactgtgccttcaaagagaaagacaggcagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaggtc

SEQ ID NO: 27718 - DNA, 3577 bp, Homo sapiens
ccatgtaagaagtgcttttcgcctcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcatttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaagaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccgttgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagatgggagcttccagcccctgcctcgcagacagatggtgaggatgaaagaatgcaggcatccctcgctatctgctgtccactctcgctgtcgtcatacctcaggagccaagtgcttttggatggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaggtctttaaagattgtt

SEQ ID NO: 27719 - DNA, 4539 bp, Homo sapiens
ccatgtaagaagtgcttttcgcctcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcatttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaagaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccgttgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagatgaggaaactgcgcctcagagagttaagaggcgcccaagtgcacacagcggctggtaaggacagctgggacctgaccccagatccctctgaccctggttctcctgctgtctgcagggttggccgaaagtgtagaggagcacgaactgagaaacgcaaaagaatcgacaccttgcaactgtgccttcaaagagaaagacaggcagcccctgccccacctgcctgcagtttgaacggatgacctaagagacaagcacgcgtccagccccgtctgtccattaagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaggtctttaaagattgttaccctagtgtttcgtttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtctttaaaaaaaaaaaaaaatggctgggcctgtaatcccagctactcgggaggctgagacaggagaatcacttcaacccgggaggtgatgattgcagggagccaagatcacacaactgcactctagcctgagtgacagagcaagactcc

SEQ ID NO: 27720 - DNA, 356 bp, Homo sapiens
ccatgcaggtggtctcctggatgaggaaactgcgcctcagagagttaagaggcgcccaagtgcacacagcggctgagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaggtctttaaagattgtt

SEQ ID NO: 27721 - DNA, 4203 bp, Homo sapiens
ccatgtaagaagtgcttttcgcctcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcatttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagggttctctttgtatctgatatatcttctggaacattataaaaaacttatgagccaggcccaggaacttcagatcaagttcaacagttctcaggaaactcagcagtctttactgcaagaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccgttgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaggtctttaaagattgttaccctagtgtttcgtttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtctttaaaaaaaaaaaaaaatggctgggcctgtaatcccagctactcgggaggctgagacaggagaatcacttcaacccgggaggtgatgattgcagggagccaagatcacacaactgcactctagcctgagtgacagagcaagactcc

SEQ ID NO: 27722 - DNA, 1546 bp, Homo sapiens
ccaggaagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagtgaaatactatggatacctggaacacttggacagacccttcgattctaattactttaggaaaactcctcggctaatgaaacttggagaggatattacattgtggggcatggagctgggccttctgagcatgcagagaggagagctggccaggtttctgttcaaaccgaactacgcctatggaacgctgggctcccctcccttgatccccccaaacaccactgtcctgttcaagattgagctgcttgacttcctagactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctgttgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgcaaaaaaaaaaaaaaaaaaaaaaaaaaaaaaaaaaaaaaaaaaaaaaaaaaaaaaa

SEQ ID NO: 27723 - DNA, 2884 bp, Homo sapiens
agtaacccctcggctttctgttcctggacggtggcggccgccggctctatgatggagcccccgaagcccgagcctgagctccagcggttttaccaccggctgctgcgtccgctgtcgctcttccccactaggacgacgtccccagagcctcagaagcgccccccgcaggagggccggattctgcagtccttccctctggcgaagctgacggtggcgtcgctgtgcagccaggtggccaagctgctggccggcagcgggatagcagcgggagtgcctcctgaggcccgactacgtctcatcaaggtcatcctggacgagctgaagtgcagctggcgggagccgcccgccgaacttagtctgagccacaaaaacaaccagaagctgcggaagcggctcgaggcctacgtgctgctgagcagcgagcagctcttcttgcgctacctgcacctgctggtgaccatgtcgactcccaggggggtcttcactgaatcagccaccctcacccggttggccgccagcctcgccagggactgcacactcttccttactagtcccaacgtctaccgtggcctgcttgccgacttccaggccctgctgagggcagagcaggcctctggggatgtggacaagctgcaccctgtctgccccgctgggacgttcaagctgtgccctatcccctggcctcacagcactggcttcgcccaagtgcagtgctctaacctcaacctgaactacctcatccaactcagccgtccaccagagtttctcaatgagccaggaaggatggatccagtgaaggaattgaagtccatccctcggttgaagaggaaaaagcctttccactggctgccctccataggaaagaagagagaaatcgacatcagttcctcacagatggtgtcgctgcccagctatcctgtggcccccaccagcagggcttccccctcgcctttctgccctgagctccggagaggccaatccatgccctccctgcgtgagggctggaggctggcagatgagttgggccttcctccactcccatctcgccccttaaccccgctggtcttggctacagagagcaaaccagagctgactgggctcatcgtggctgaggatctgaagcagttgataaagaagatgaagttggaggggactcgctacccaccactggactcaggcctgcctcctctcctgggggttgtgacccgtcacccagctgcagggcatcgcctggaggagctggagaagatgttgaggaacctccaggaggaagaagcctctgggcagtgggacccccagccccccaaatcctttccacttcacccacagccagtgaccattactttgaagcttagaaatgaggtcgtggtccaggcggctgccgtacgggtctctgatagaaacttcttagactctttccacattgagggggccggagccctgtataaccatctggctggtgaactggatcccaaagccattgaaaaaatggatattgataactttgttggcagtactaccagggaggtctacaaggagttgatgagccatgtctcttctgaccacttacattttgatcaagggcccctagttgagcctgcagcagataaagactggtcgaccttcctgtcctcagcctttctacgtcaagaaaaacagcctcaaatcatcaaccctgagctggttggactttactcccagagagcaaacactttacagtccaatactaagaagatgccctccctcccatcactccaagctaccaaaagctgggagaagtggtcaaacaaggcctccttgatgaactcatggaaaaccaccttgtctgtggatgactacttcaagtacctcaccaaccatgaaacagatttccttcatgtcatctttcaaatgcatgaagaagaggttcctgtggagattgtggcccctgccagagagtccctagagattcagcaccctcccccattgctagaagatgaagaaccagactttgtgccaggagagtgggattggaacactgtgctagagcacaggctaggagctgggaagacaccccacctgggagaaccccacaaaattctgagcctgcagaagcatctggaacaactgtggtctgtgcttgaggtccctgacaaggaccaggtggacatgaccattaaatatagctccaaagcccgcctgaggcagctgccttcattggtgaatgcctgggagcgggccctgaagcccattcagctgcgggaggcattgctggcgagacgagagtggtttgagggacaagcttccaatcccaaccgcttcttcaaaaagaccaacttgagctccagtcacttcctggaggagaatcaggtccgaagccatctccacaggaagctcaacttaatggagtcttctttggtttccctcctagaggagatagagttaatctttggcgagccagtgatcttcaaggggcggccctacctggacaagatgaagagtgacaaagtggagatgctctattggctgcaacagcagcggcgggttcgccacctggtctcggccctgagggatccccaccagtcaaccctgttcaggagctcagcagccagcctttagtagctcctgggaatacccctattactccttgaccaggcccagtgccctcaaatgcctccctcacccctaaatggccagcagctcatctagacctctttactgctttggaagaagaaatatttgtctatatctgggagtggagggttcaggaacattatgcttccaactatgaagggattgagactaaaactattgttttcttagtgaaattctcatgaaagaatccccaagcctagtagtcccattatgtcaagccttgcacaatacaagccaaatctcctatatc

SEQ ID NO: 27724 - DNA, 2010 bp, Homo sapiens
cggcgggtggggagcggcaggcgggcagggtccccggaggcccccgggctctgcccctccagctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccagccagcccctgcccgacctcgcagaccacctcagtgcgcaggcgactgccctcgccaggccgcgccgccctgcctcgctcaccccgccccgcgctgaccccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaagggcttcactgccatccacttcgccgcccaatggggcaagattgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgctcagacatgcaacggctccacgcccctgcacctggcagcccgtgacggcttgctggactgtgtgaaggtcctggtgcagagtggcgccaacgtccatgcccaagatgccatgggctacaaacccattgacttctgcaaaatatggaaccaccgtgcctgtgcccggttcttgaaggatgccatgtggaaaaaggacaagaaggactttgcccgtgagatgacgaaaatgaagatgttcaagagccagctgaccctcatggagcacaactacctgattgagtatcaaggtcaaggatgcagtgtgcacttcccatttgccttttcccccatcacaccagagactctcctatggcaggacatttctctactatcagactgtggattcctttggagaagaagggaattgtctttctaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccgcgatgtggaatgttagcaacaaccccgccagaccccccaccacccagatcagccactcgcagggcatccgcctgggcgtgcatccagaccccactccggagcacgacttcagcagcttcctggaggtgaggcctgatgggcacggcggtgcgcggctgcacacagtggacggccactgggtggcgcccgtgccgcggctgccttttgaggtgctgctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccctgccctccccacaaaccaacccataaatttattatggctacctctccccctgaggcagcccagtgaaaaaaaaaaaaaaaaaaaaaaaaaaaaaaaaaaaaaaaaaaaaaaaaaa

SEQ ID NO: 27725 - DNA, 3580 bp, Homo sapiens
gccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccacccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacactacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttgaactatgtccctcactcaagatcttaaggataaccgtaactgaagttttatatttttccatttacctactttcttttacttgctttgaacattatgcctcaccaatagtaaatgttcatgaaataatctcttgaacttttggtatagtaaggtaactctaacagtattactgtctttttcagcaataacagaaagcaaaaatgggtgggttttttttaagcagttattacctcagcattttgacatcagatatgcaaacttaatggcgttttgtttttttatattctatttgtattctttccccagtatttcccatggggatctccacaagtttggagttttttcctggtgcacacacgtgaggagatttaaggtactatatgcaagtgttttactaaaaagcactgaaattcttctggcaatacaagaaccattttcaggatcttggagttacttccttcttaatctttcttaaagcattcactgatgtttttgttttttcaaaatgaaacaaaaatatcacattgagaagctagtctatgttctgtcactaacatttaaactttgcagactctaacaaaaagcacaagaggtcacgtactattatacaaatttagcggtactggatttacctctgacattaacacactcaggcagagaccaggagtgatcagcaggtcttcagaaccaaaaaacctttctgttcacatttcatctgatttttaaactgaggcaggctttgattcttctgaaggatgccaagaatcaaactaagggaggactcactgttaaagatgtgttctgatgtcttatattaagaccaaatgtgacatgatgtgattatcttccagtactttgcttttaggtaccatttcatgacattttaggaatgagtattggaaaatataaagaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaagctcattgagattctttaccaattctttacaagatttctgggggtgacagggaaagcaaaaggacttcaaagcaaaagggtgcacaagagcttacttcaccctgaaaatcagtattattaatgaaaagtactgttttcttaaagaagtcgaatgtcctttagatgaacaagaccaagtatacatctccattagattaaaatgtagcacagggttaaaaattatcagtttaatctctttaagaacagtattatcagagtttaaaatgagttagctctgtttatctacacacagcaaacccattcgcagcctcttggccacatgtattcagatgtttgaaatagtgaatcatttcattttcattctaaaacaatactgacttagccatataccttctgtttgtcaatctgaaacttgcttacatctaataagtagacctcttataacactgcaaccattctaagagttggaatttatttttgccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttgatttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaaaaaaaaaaa

SEQ ID NO: 27726 - DNA, 2881 bp, Homo sapiens
agccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtatagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagtcaaagattgtcagagtacaaatatttctggaataagactctttcattacttacttttactaaaagggaactaaccagtattaaaaatgaagtatatgataattaccaaaactggacttcattgaaaggagcagtttttctacaaattaaatctataagtgaaacagccttgacagaaatagacatactgaataaaagttcgacagtatcccagagaaataaagtatgccttgaaaaggaaatgaaaaatctgaaattgttgtcagatgcagccatattgagatctcagcagattcggacatctagacaacaggaagtaaacttgcaaaccagatgctatgatttgcaaaaagaagtactagatttacaatgtctagtagaggcacttggattaaaacttcagaaggcggtgacagagatggacaactataaagaaatgcttatgtaagatggagaatattaaacaacttataacagtgctctgtagatgtgttacaaaatggcaagaattaggaagaaatgacaagaattataaagaccctgcctgggcaacacggagaaactttgtctccacaaaaaaatacaaaaattatccatgcgtgttggcacactcctgtagtcccagctactcgggaggctgaactgggaagatcacctaagcctagaaagttgaagctacagtgaaccatgattatgccactacactccagcctgggcgacagagtgagaccctgtctcaaaatgaataaataagaataaatctaatgaagctgatgactgtcaaagagaacttaaaaaactgaagtttgaatccattatttctgagtcacagcatactatgctgcttaaggaaaaagaagactctttaatgacttgtcaacagatatataaagcattacaggaagagctgactgtgaaagaaaagcaagaagaagacataaagagaagaattaaccttgcagaaaatgaactggagataaccaaaactcttctgaatcagacaagggaagaggttttaacactgaaaaatgaaagggaattgatgctgatttcacatcagaaaagcatcgagcagctgcaagaaacccttagacagaagctgctgagtgatgataactggaaggagaagattgaagcagaacttgccaaggaaagggcccaacacttggttgaatttgaagagcaagctcttctctttaaggaagaaacaaaattgcaacttgatattgaaaaagaaaaacaccaagatgtaatccaaaagtataagaaagaacaagaggaactacaaatgaagatatctgacttaatcacaggcgctacaagagatctaaggcaggaagtgaccactcttaaagaaaaacttcacaaatcccatactcggtacactgaagaatctaattcaaaggaaaaagaaattgaaaatcttaaaaatttggttgcagaatttgaatctcgcttgaagaaggaaattgacagtaatgattcagtttcagaaaacttgaggaaggaaatggaacagaagtcggatgaactgaaaagagtaatgctggctcaaacacaactgatagagcaatttaaccagtcccaggaagagaatacttttcttcaggagacagtgcgtagagaatgtgaagaacgctttgaactgacagaggctttgagtcaagccagagaacagctcctggagctcagtaagcttcgtggaagtttaccattctcaccgtgttccctcagcaagggcagcctaacctcccctgctgcagcagtcagtaatcatggagagagaagccttgcaagactgaactctgaaaaaggaatccaaattcccaacctgcgcggggtgtcaaaacccaccactttcccaacctcagataagccgaagagggttagatcaggcgtgcccattctcccccagccacatcctcccaggggtggagcatcttcagcaaatgagactagacagagactggctgccattcttaggagaaggcggagtcagcaatgatccaaaatgaggagcaggaagctccctacagcgtgcacgctctttcagagagtgccaggaattcactgtaactgagaatgacaatgataaaattattttcacagatcaggaaggcatacctatagatgtatttaacaaaagactgtaaaaagctggaaaattgtgaagccttatttttcaagagggttttgatagagtaacagatcattaagttgttggtattccagaggtccgatttctatgtttatgttggaatgtgctctatgaatatagccttttagagatcacaggtaaaatttttcacccataacatcttttcaatttcttgcgccactacaagcagatatatttccacaaaaaaatagattgtttgagattt

SEQ ID NO: 27727 - DNA, 1466 bp, Homo sapiens
atactcaccaggatacccctcgttaagggcaaggcggcttctggctcttccgcaggctcagttgtgggttcctgtgtgcttagtcatcgggtccgacacaggctggactgatctggagagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcagcaatcgtgttgttttatttttagatggatgtattttcatttaatacgtgggagttatatgaatatgtcctagcactaagggaagtgtaacagttgattgatttaggtggttttatgcagccagaacgattggaacaggaaaggtgtggaagggatattcttaggtcgtcacaaagctgagctgatgggagcaccctccccagaggtcaacaatccattcgttaactcagacacttaacctttacctttacttctgttggcgaaaaagaagtgctcctttttattacactgatttatccttccatcttttccttggcatttaccatcttccatctcccccttcacttttttcagatatgtctacaaacagactccaatctcagtcgcactaaaaataagaacaaaacctaaaccttacagttctttcaaattattaaatcaatttattattcctttctttggcaaaggttccaaatttttactttatatttgtaattttactatttgcattcagtcccagcgcattaatctgaatctgctgtcctaaaatacactggtgaaaacattacttgtacaatctcctatcagaaaactgttcatctactcactgtagtgccctccttgaaatgtgtgtttgttcattcaactaacaatatttggggatccctgtagtaaacactgtatgaattttacacagtctggccatcaagaaagatcacggagtatattctagatggggaggctactaagtgaataggaatcaccacgctgggctgtttattaggtacagtaataaacataagtactggttgcagtgaaaaaaaaaaaaaaaaaaaaaaaaaa

SEQ ID NO: 27728 - DNA, 3224 bp, Homo sapiens
ttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaagcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaaataaaagttgtttggaaaaatccaaaaaaaaaaaaaaaaaa

SEQ ID NO: 27729 - DNA, 3271 bp, Homo sapiens
ttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcagacctgtccgaggagagtttccgccaggaggggtcccggattccccaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaagcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaaataaaagttgtttggaaaaatccaaaaaaaaaaaaaaaaaa

SEQ ID NO: 27730 - DNA, 2911 bp, Homo sapiens
cgccagcggtggcgcaacggctctcgtccccgccctcctgctacctgtagtcgcctgggccgcccccggcccagccctgccttgcgccaccctgcgctgtccagactgaggggtcaggcggagagccgggccgcgcccttcggtcagcttctctccctttcacccgcgcctcctcgcgagacccggggctgggccgtgcccgtcgccgcgcagcaggaagggagcggctgccacggaaaacgcctggccggacggtgtggctggcggccctgcctgggcgcggagggcggcggtggcgggccccgcggccttctctcagcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattgacatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaaaaaaaaaaaaaaaaaaaaaaaaaaaaaaaaaaaaaa

SEQ ID NO: 27731 - DNA, 2929 bp, Homo sapiens
gtttgcagcctccgtgccagggccgggggtgcggttcgggacgcgggatcctaggtcgggtcctgccccgcccatgtggcgccggcgtctgtgttgtctgcggtctccagggcagcgccggggcgggcgggggcccgggcggcggcggcggcggcgcgggaggatgcggggcccgtccgggtcgcggccgcggaggagcgccgggcaggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacagatctcctaccccgtcagagtaacagacaagacgtctattcagaatgccaaggaaatggaaaatgctgccatcgatcctgaagataaatggcatcaaagagcacaacagctaaagaattaccaggaacactggtctcaatatgaaagtacaaaatcaagcaatgtaccaagagggcaaccttctgacatggtgaatgaccatcaaccttccagaagaccagccaagctcaagattcgaaagcagtgtaaacaccagaatggcctgaagtcttccacaacggaagaggtgactgccagtcaggggaaccagaataaccctcccaggcagcaacaaaaccaaaataagcctcttgatacttcaacaaagcctgaatcgattgtgattatgcatgcctctaacaatgatgtacaagcctcaagggcacttagaagccacaatctcaaagaaacctccaatacatttgctccaccaaaacaggcttttgacaaggtcttatctaaaaactctactggatgtgactctgggctgaatgttaataaagaaagaggacacaaagaccaagaagagaaaagattttcatatcagcagctacacaccctttctgacatggatttgaacaaccttaatgaactttctaagagacacgtgctcctgagccagaaaggctctcagtttgtttatcacataaatactcatggatcaaccaaaaataagaaacaactcaaacagccttatacagagacaaaatacaggaacttagaaatgttatggaaattccattcttcttctgacagccagacggttagagcttctccagattcatggctcacccagataatggagcagcatcagcaagccttggtgcagctgaccgacgtgcagcccagtgaaggggccttatccagcgtcacgcttccacctatactgtcaagggtagaaagtgaatcccaactcagttcagagagaagccaaagaaaccaagtgaaaattagccgtagcaattctgaaggctatctgtttcaactggaaaagggaaaaaagcataagaaaagaagcagcagtaagaacaccaagctgaaaggttatcagaaaagagacgtgaagcttggaggcctcggacctgactttgagtccatcagagacaaaacgcaaaaattaatacagcaaaaggaatatgcaaaacaagtcaaggagtacaacatgaagacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttgttttatattgaaaaaaaaaaaaaaaaaaa

SEQ ID NO: 27732 - DNA, 1865 bp, Homo sapiens
gtttgcagcctccgtgccagggccgggggtgcggttcgggacgcgggatcctaggtcgggtcctgccccgcccatgtggcgccggcgtctgtgttgtctgcggtctccagggcagcgccggggcgggcgggggcccgggcggcggcggcggcggcgcgggaggatgcggggcccgtccgggtcgcggccgcggaggagcgccgggcaggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacaggtcattttgagagtaaattctctcccacgtgatggattcaaaaccttttggagccagtaaacttagttccatttcacaggtgcacataaagaccttcctgcccacctcctatggacatgtccagggatacaggacaagagtggggttagaatggtagagtccaccactcttactggaaagagcttgagatttatcacctgctaatgtgaggtcattttcaaatacaaaggagaggttattatgttaaatgtggttgcccttagacctattccaaatcccaactggtatttttttttaacatattctaacctgttctaacctctaagcattttctaatggaacaaaatagatgaggtggatgaacatttgtggcttttcttcagagactcccttttttgtcttaaagaattacgtctggtggcacgttggctcatgcctgtaatcccagcactttgggaggtcgaggtgggaggatcacttgaggccacgagttcaagaccagcctggccaacatggtgaaacccatctataccaaaaatacaaaaattagccgggtgtggtgatgcacacctgtaatcccagctactcgggaggctgaggcacaagaatcgcttgaacacgggaggcagaggttgcagtgagccgagatggcgccactacactccagcctgggttatagagtgagactctgtctcaaaataaat

SEQ ID NO: 27733 - DNA, 797 bp, Homo sapiens
agcaacaggactctccatgtggcaagggcacctggaggtgggagggcaggagcgtcgtcttgccctggcagaagaagcggtaggctctgtctgcgtggcagctggtccccagccctaggagagaagctgtctgtcgtttgccatggcaggtgtgaaatacccgggacaggaccctgtggatttagacatataccaaagctcccacatggtcgactatcagccctacaggaagcacaaatactccagggtcacgccgcaagagcaggcaaagctcgatgctcaactccgggacaaagagttttacaggcccatccctaaccccaaccccaagctaacagatgggtaccctgctttcaaaagaccccacatgactgccaaagacctgggactccccggcttcttcccatcacaggaacatgaggccacgagggaggacgagcgcaagttcaccagcacctgccatttcacatatccagcttcccacgatctgcacctggcccagggtgaccccaaccaggtcctccagagtgctgactttccgtgcctcgtggatcccaaacaccagcctgctgcagagatggccaaaggctacctgctactgccagggtgtccctgtcttcattgccatatagtcaaggtccccatcttgaaccggtggggacccttgatgccattttaccagtaggaaggatgaaaataccttccaaaggctcttccaagggcatgtggaacaatcctatgaccttggagtgcagagaggagaactgaaaataaaactggaaagatgttccaactgc

SEQ ID NO: 27734 - DNA, 808 bp, Homo sapiens
agagtctttcgttctttctggtgcagcttaactgatttgaagaagccgaagaagaaaatccagtagcacggttaagactttagccatggcatctgtatcataccaaaagccaacatctactactgtgggaaaacaaatgatttttacaggtccagactacataaaggattatttacccaaaattcatcagcacacctcctatgtaggagaacagcatctggcgttagaaaaaactggagatctcagatatttatggaggcctgcctcaaatagaagcttgccagcaaaatataaacataagtacgtcggtgaaattggttggagaataccacagtataattttatcaacaaatcaagactggagagtggctttcatatcaagtatgaagaactaagtcaagcttctcttgattcaataacccacagatatcaaaacccatggcaaccaaaacctcatgtcctggatatgcaaggaaaacagagtcgcgcttcttttgcctggcatatgagtgctttcgaggacactgatcagagaaattccaaatgggctattcttgttaggcagtgtaagtcatcattgccaagagcttccaaaccacctaagctgccgaagctaccaaaaaggaaaagaaaaggaaacattaacctctaaatcagcataactcaacctgcttttagaaggagaaactgcctactactgtataacaaaaaataagatcataataatccacaagtgcttctcatattgccccaggacagatgtcttgcaagagtacgcttcagcttaaagcccaaataaacagtttgg

SEQ ID NO: 27735 - DNA, 1448 bp, Homo sapiens
ccacgttggaggaagagcccacctgagaatgacatcaactcagagggaagtcagcagagccaagaggccgggagagatgattcctgatgacatcatccggttcctgggtgcagccatggtagagttggcctcgaacgttgtccctggcatggaggtgaccagaggccaccctcacatgtcagcagacacctccagccgtgtcattcgtgttcctggttagcaaagtttgtaggggtagtattctcagttggcattcctagctgagatgtgtagccgggaggtcaccacgctgcagggccttggaaccacttctgcctccgaggagtcccttactgatgatcataggctcctcaaggtcatcagccagggcagctttgcagaagtcaaggcagctggcccagcacattctcactgggaccaagatggctgtggaggtcaccccaacagggcagcagggctcctgcagcccccagggtctgtactgcagggtccatatgatgaaggcccttaatcacccgaagatcatcagacccacgtggctggcaccgagaacaggctgttcctagtcatggattaagccagctcgggagagctatccgacttcaccctcgaattcttcttgaagggggaagaggcctgaggcaagttccagcaaataggatattccatgcagtgaggcttccagaaggaaattatccacagggatctgaagtcagagaacttccctgaggaggctcagcacgacatggaaacaacagactctggctttgataccagattcaccgtaggctgaaagctgatccccttcggtgggagctcctcttatacagcctcagaactgttccccgggacaaaagtacgatgtaccctggtgggcgtgtggagcctgggagccactgtctacaccatggtggccgaggactgccatctgttgggcagacttttgtggggctgaggacgacactaatactgtgtgaatggtgacaggcgatcccattccttgtttccatagaacgagaatgcctcataaacacaattctggccgttgactccagggagaggccctcactagccctcatcatggggcgcctatggattaacatgggccaggaggagacgctaactaaggccatactgggagctgctccccgatcacccggagtctggaaagcgctcctggtgtccccgggagatgaggcagaccatgtcccatcgttgttgaaaaaatatgtgatgataccatggccggctatcagatcctgggctgcaggaaacccgaggtgtggggcgccatcatcacagtgaagctcctgccttcagcagatcctactacttgccgccattctcccccatcacatgaaaaaaactcctctaatgaatattaaacttgtactggaaaaaggtcaataaataaataaataagaaaaaaaaaaaaaaaaaaaaaaaaa

SEQ ID NO: 27736 - DNA, 1300 bp, Homo sapiens
agcaaatgcttccagtcccaggagcacaaacatcacatggtgtgtgggatacaagaggctgctgagaattacaggaagttattccaggaaatattgaacacatcgagggagaaacttgaagcagctaaaagcatattgactgatgagcaagaaagaatggcgatgattcaggaagaggaacaaaattttaaaaagatgattgagtctgagtatagtatgagactccggttgttgaatgaagagtgtgagcagaatctccagagacagcaggaatgcatatctgacttgaacctgagagaaacccttctgaatcaagcgatcaagcttgccaccgagctagaggagatgttccaggaaatgctacagagactgggccgtgtggggagagagaacatggagaaactgaaggagagtgaagccagggcttctgaacaggtccgcagcctcctaaagctcatcgtggagcttgagaaaaagtgtggggaaggcaccttggcattgctcaagaatgcaaaatactccttagaaaggagcaagtcactgctgcttgagcatctggagcccgctcatatcacagacctgagtttatgccacataagaggactcagcagcatgttcagagtactccagagacatttaacattggatcctgaaacagctcatccctgcctggcactatctgaggacctgagaactatgagattgagacatgggcagcaggatggggctggcaacccagaaagattggatttcagtgccatggtgctggctgcggagagcttcacctcagggaggcactactgggaggtggacgtggaaaaggcaaccaggtggcaagtgggcatataccacggctctgcagacgcgaagggcagcacggccagagcttccggagagaaagtcttgctcacggggtcggtgatggggaccgagtggactctctgggtcttcccccctctgaaaaggctcttcctggaaaagaagttggacacagttggggttttccttgactgcgaacacgggcagatatcattctacaatgtgaccgagatgtccctcatttacaatttctcccattgcgccttccaaggagctctcaggcctgtgttttccctctgtatcccaaatggagacacaagtccagactccctcaccatcttacaacatggtccttcttgtgatgctactgttagcccttaatcttctgtgtgtaaaatccaagaccacgagacaccagaaagttggagaacaagactttgaaagaatttgtgtaaactaacccaataaaaagcgttccagg

SEQ ID NO: 27737 - DNA, 1854 bp, Homo sapiens
ggatctcctgcccttggtcgtaagtgccactacctgtgctgagtttttcaaaggtcagagcagattgaaccattgtggtttcattttccctgattttgatttttcttatggggaacctgtgtggctgcattcaaggtgactcgaagaagccttccaaaaagcgtgtgaaaaggaagccctactctactaccaaggtgacttcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgtgaaggtggtgcaggtggcccctctgaggcgtgaatctagagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggattggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatga

SEQ ID NO: 27738 - DNA, 347 bp, Homo sapiens
tgccactacctgtgctgagtttttcaaaggtcagagcagattgaaccattgtggtttcattttccctgattttgatttttcttatggggaacctgtgtggctgcattcaaggtgactcgaagaagccttccaaaaagcgtgtgaaaaggaagccctactctactaccaaggtgacttcagggagcacattcaatggtacgtattctggaatcactcactggttgttagaaaaggattctacaggaaatctggagcttaactgctggcttttgtccggagagcctccatgatccaagacatctggtgggaatgaggatgtagggtatagtaaaagaaactggttttcc

SEQ ID NO: 27739 - DNA, 531 bp, Homo sapiens
gctgagtttttcaaaggtcagagcagattgaaccattgtggtttcattttccctgattctgatttttcttatggggaacctgtgtggctgcattcaaggtgactcgaagaagccttccaaaaagcgtgtgaaaaggaagccctactctactaccaaggtgacttcagggagcacattcaatggtacgtattctggaatcactcactggttgttagaaaaggattctacaggaaatctggagcttaactgctggcttttgtccggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatctgtgtttcccccaggaaaaaaatgttgtgtttacccagcacaactctcagt

SEQ ID NO: 27740 - DNA, 1042 bp, Homo sapiens
ctgccaagatggagcgaagggaacatttaaccttgactttccacagtcctgaggttcccaaaataaaggggaaccggaaataccaaaggattatctccaatattccagggccttctttctcatctctgtctttaccatacttactggccttggctggctcttcagctcttggatccttaatcgaggaagcatgaccaccaacttggatctgaaggtatccatgctcagcttcatctcagctacctgcttgctcctctgcctcaacctgtttgtggcacaggttcactggcatactagggatgccatggagtcagatctcctatggacctattatcttaactggtgcagtgacatcttttacatgtttgctgggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtcttttgcgtgcattggatccaaaatatatatgatagtcataaagtaaataactcacttaagaaaaacatttctaaaagaaaacaacaatgtttagagtcatgaatgaaagaaactagtgaaagatgcagtgtgtagaccagagacctctttgggtatcagggatctcatggaccagaatggcccgtggagaagaatgttaattacttctgtttggaattttctttattatgtgtggctttgggtatactcaggatggaaagcacttggacaaatactgttgaatctgaacttaatagcattaccagaaatggaataaatatcaatggatataa

SEQ ID NO: 27741 - DNA, 1042 bp, Homo sapiens; identical to SEQ ID NO: 27740

SEQ ID NO: 27742 - DNA, 4007 bp, Homo sapiens
tgacaccttccctccccgtccgggctctctgcagcaattcatcccgtcactctcccaacgaccccgggcacacctccggcagatgcgaaatatgctgctcctcaggaggaaagatgacccggaggaccgcgggaggaccttcccactcgcgatcttcccagtgccccaaagccagggaccccactgccgcctaccccagcccgcggcaccgaacttgctcacaactgtgactcctcaggtcggattggacaccaccggaaacggaaattcaccgtcgcgccgactctccggagggaaacaaaaaggcagaaaaaagagaccggcgcctggacgactttcaggggagagctggaagaaagactgtcaacagctgagtgcgggcgccggcgccgtctacgcagtgcgttccaccgggtccgtatccctcccgattccgccccaccccgccctcggaactcgctgcctcaactcctgcggtgggactccggagcagcgtacaccgcccttgccttagtcctccccaaggccagggcagctgtgcggcctggcgcgggttacttggtgtggtgcaaaaagccagaaggagacacatttggtcctggccaccccggagtcacccaaaccaaaaggtaaaaggaacataaaaaagccttctggaaagtgtaaaaaaattcattgcacagtgatttttgtcttgtgaaatcatagttactgttattagcagttttttaaacgttttatattcattttttatggtgttctgacatatgagctgcttcaagtgtttttggacatagcttgggtgtaaaatgtaaaaagtggatattttcaatttgtagctttcttttttgaaacttactgaagtttgttctaaatatatccccttctttctcacctaccccaacacatttttaaaaaaaacaccaccaaatatccattacagcattgatgtgagtgtagatgaagtaaaaactttggcttccctgatgacatacaagtgtgcagtggttggtaagtgatcgcctttcttgctacctaatgagaactctggggaaatatgtttactcacatggttactgttaagatgctatagaaatataccttatcagaactgatttttttttaagttgtcctctttaagacctgcatcatttttcaattagtctaaattaatatatagcctttttttatgtgagggattttttttataggagcttattgaattttaggtctagatctttgttttcaattcctcaacatattctataaataagaccaaattatagtagaaggatagtaaataagctattatcttttagaagttgtaaagagcactgattaactctatattagagaccccgcccctgccttggctgcgcgggcccccgccaaagggcccatggtcggcgcagccgagctggcgagggcagcgcgggtcccccggaacgccccccgaggcgagcgctaacgaggtccggcaccatgtgctaggtcactcccagtgcaaggccacacttgggccatccgagcaacccctcctcacgtcaggggtcaccctccccaccacccattgcagagttcatctggctggccacacgcagccaaatggaggccactgagccacaggatatggtggtctatgaccagagcacacgggacgccagtgtgctggccgcagaccgcttcctctccatcctgctgagcaagctggacagctgcttcgacagcgtggccatcctcacggggggcttcgccaccttctcctcctgcttccccagcctctgccagggcaagcctgctgccctgctacccatgagcctctcccagccctgcctgcccgtgcctagcgtgagcctgaccctcatcctgcctcacctctacctgggctcgcagaaagacgttctgaacaaggatctgacgacacagaatggaataagctacgtcctcaatgccagcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccagcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaactgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatgagctacctgaaggggcccagctgagaagagtgggctggaccgagctgctacccccatcgctgggcttggagatcgaggccattcgacaggaagtggcaactgctgatctctccaaccctctgtgtggggtgtggcagtgggaggaagtcatccatgagaccagtgaggaaactgagtttccatctgaagccccagctgggggacagagaaacttccagggagagccagcgcaccctgaagaaggaaggaaggagccatccatgtggttgaccagaagagaggaagaggaggatgcagagagccaggtcacggctgatctccctgtccctctaggagcccctcgccctggagacatcccagaaaaccctccagagagacctgcgcggcgggaactccagcaagccctggtgcctgtgatgaaaaagctggtcccagtcaggaggagggcctggggccagctctgcctgcccccacagcggctcagagtcactcgacatccactgatcccagctcctgtcctgggcctgctgctgctgctgctgctctctgtcctgctgcttggcccgtccccacctcccacctggccccacctccagctctgctacctccagccccctccagtgtgagaggctctacttgcccctcagagcagtgtctagctcaataaatcccctggccctctctccactgggatccccattgttagtccactgttgcgcaggcttaccctagatagagtacaggggatccacatccctgtatttttatgtgaattctcctagttttttaatgctgacatttcttaacaatagcaaaactcccccagtaatggattaagcactaaggattattccctcacaaaacaagcctggcgagggcagctgtgggcacacagctaagtctcggttgccttggggtcagggcctcagtgattctcctgtcccctccctcatgctcaggagttggcagttgtagcttcctacatcacatctgcgggaaacggaaatttcttccttcctttttataaagagaggcagtagcctcagtgtgcagtgggtagattcaaatcatattcataataaaagagaagcagttgcctgcccag

SEQ ID NO: 27743 - DNA, 2803 bp, Homo sapiens
tttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccaggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctgaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcataattgtaggtcattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatgtgcctatgttctgctgttgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctt

SEQ ID NO: 27744 - DNA, 1832 bp, Homo sapiens
gcaattaatgctgaaacacagctagcatacatagcaataacttaggcaaaaaggcaacactcaagcaaaatccttcctggaattaaaatcctgttattaggtcaaccaacttttcttttaactaactaaataaacaacagcaagacatgaaacctagacctataagtttagtacctgaatctcttgctgattcatgcatttctattaatcttctcagtcagatgtttagctcagatctgtcctcttatccaagcttttccaagagtctcctagctacacttctggcatcatgttacaccctacaatccagctcttcacagtctcctgacttctttttaaaagttgcatactatatatacatctctctcttgcttaacattcctcagttattccctagtggacacagaataaagtctagcttcttagcatgttacttgggctccttcagtgccagtccccacaaattcctcactcatcttgcagaagctcccagttttcaatattctcctaaatgctgtggaacctctgtctatgcaggattctaaagatgaggaaaattagtcccttaagactcagcttaagcattgccccttgtgcctttactgttagtttgcccctctgttcttaagagtttattcctggcattgctcttaagggaaggaagtttggcagggccaagagtcctaaacgttagacctttctctctaaacactaacaacattaaaactccattcaagaaggagcaaaagaagccatcatctagaaacaatgttgataaccacagttcctgaacttgggcttgttaaaagactttatctccatgagtatactgaaacacatatttagtttatctcctattatcaagaaagaaatattaaaacttcactgttgaggatcactctgaatatgaaagtgctcaagacaatcaatcaggtctcgagatctagaaattagtataagtactgagtgctaggggaaaaaaattatactcttcaaactacatccctgggagtgttagtgatgtcataattcactgaggatctagaaactacaggatggatacttataaaagataagggaagtatagtgcataggttgctgagaggtggagagaaagttgcttacttttcctgagcctcaactttctgaaaacatagaaacacaattagatgatgagttatgaggtgaaggaggggatgactcagcagcaatgtgccagctccatagtgacttctccaccaagctggagaaggatttgcagcaatggttccagaaccaactgtgtgtatctacaggatgaagatcatttagactatgatcatttagactgtatcacttttgattctttctatgttgcccaggctgatctcagattcctgggctgaagtgatcctcctgcttcagcctccagagcagctgggattacagcagcttcagtgctgaggctaatggcaaaggaaacaccaggggatcagtgagtaagaacttgtcaagggaacaaagtctgaagatggaacggaggaagaggagaaaatcttccaccaaaaaaaatattaaaatctgatcttcaaggaaatactgaatccacatagcactcccctccgctcccttcttaggcacagcattactcaccatctcacagaggagaaacagaaatataaaataaaaagtggaaacaatcattaaaaatacttagccactcccacgtgtcctgggaaactgagaacacagtaactaccaaacaaattacatgatgtcacatgccagatacctaaaggataacatcaccccatcttcagaaacagaagaaaataaaatagcaaaagcaagag

SEQ ID NO: 27745 - DNA, 1929 bp, Homo sapiens
ataacgggcgttaataaccataccctgttagactaagcatggtccacccgcgaatcctctacagagatggccaagcgctggggtcgtggctgcgtcctctaggccagccttgtgcaaaggaccttctcaccacagatcagccagaccatcttcctccttccaagtcatcaaagagttccaagctggtcacctgtcccttgatgttcccaggaaaccaggaaagaggacccctgcattttatcttcccatccagagtggcaggatctctgcctgggaaacaggcttcattcagcacagctgtggtagcattaacaaagcaaagtgggcacatgtagaagttgaagctaaaacattcaagaactccagtctgtttctgtggatgttaagggggtgaagataaaacaatggaggtgatgaggaggaataacttgaagacagtttaaagccacagtgatacaaagaatgaagagaaggaaggtgctggattttactaagaaaacagactgagttcaggagtctcaccagtagaactttatagtattgcgtttcgattacatgtgtgtgaattttaaaaactgattaccctccagtaaaaatgtggaaccaatttgcatttggattaaaacattaggtttggggacaaaagtggaccccatgctgcctgagatgaagagagagagcaggatggcagaggaatcaccagctcaagaaaccccaagacttggacagtcttccagcagaagaggccagggtctctcagtgtactactccaaacaggcctctcctagagatgtagtctgggaaggtccaaaacccaccagacaggcacatccagtggggaaaagacttcccattccagtgtggcctgcatccctcacctctgcttcccagtcttctgctgacctcagaggagcagggtggccattgctgatctgggttagggagatgccagaaacacacccaggtttgaaccacaggttagtggtacaaagtcacagtccttgtgccttcagaaaacccagaggccccaaatacgagtgggaagagagttgggaaaaactgaaccagactcttccaatggccattaaagagaaaattcagcaacgcttgcctttgtctttgaccctgagaagttaagggacacagattgtggcgccgtgatggaacatggagggaaggcatggtgtgcttcctgcagagatgcctctggagtccctgtggccacgggatctcactggccccctcttcaggcaccttgatggggctcagtggggccaggccaaagggtggaagtagaaaagcatcaacaggctgtccagatcaattggcaccatccaaggccctgctgcacccacacatggaggtcaccagctcagccccaggggttctttcacacacaagctccttccctaaggagtcctgtggggttccacactcagtgtgctgcccaagtcagagatttaccacagatctgtctccccctcaacctggactcaagttactgtggtgagaaacctcactgtccatggttaactgaagaaatccctccttcagaaagaacttgagtagtagatgaggtggttagacaggatctttttccctcaagctgtttggacgccacagccaggaccaactctgacagctgcgagagagagagcccctccaatgtggaacctcctacacagccccccttttgggtccctggatatgagcccccagcaggaccaccactctagggggaagtctccctcccatccctcagatccccacattgttcctcctgtaggagaaaagtcagccctgcccctggagcttctccaagatggcactggactcgccgttatcttgaggagccaggagctgaaatggctccggcttagcaacccagtatggccaaagtggaaaggttctctgtcctttgcagtcacc

SEQ ID NO: 27746 - DNA, 2556 bp, Homo sapiens
acgaccaacagctgagaacgcggcgagtatggaagctgcgtcttaggagcctgggaaagcacttcgacgagaatagtttggtttcgtacacaggaaaatgtctaatcgacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatctcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgacagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattctggcggcaagaagaacttacacgtattaaccaatcttttactggagctgaaaggaaagctgctctgtgtgaacttctggaaaaagagactcagataattgcttccattgggagacatagatacattgcttatatggcaaatcaggaagcagcaatacaagcttttttggataagtgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcagctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgctaatagggtaatacagaggtcacagagtatggaaatgg

SEQ ID NO: 27747 - DNA, 4092 bp, Homo sapiens
agcgggtgttatggagaaataggaggtaagcatgcactgtaagttagatataggatttgaaatgaaggagaaatatttatgtggaaaagacatttccacataaaaatatttatgtagaaaagaaaatattcttgagttctagtctcttctttatttgaaatgatggtgtagattcagtccacatattttatagataaagatggtaaggtaggataagtctggaaagagtaatcaatatattgtatttcagcacgaattcatttatttttaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacactgaaaatgtagattattgtagatacccagagtatgttcatcctaataaggctaagcttaataaatgttcaaattttagtgtccaagatagcaaaaaattagccaatggcacacctgaaacaccaactgtagaagcagacacctacacaaagttatttcaggttaagccagcgaatcagaaaaaaatggaggagacaatccctgatcagcagaatttcacatttccaaaaactacgccacatctgacagagaaacagtttgcaaaggaagcagtattcactgctgattttggcttaacatcagaatatggactaaaacctcacacagcttgtcccgctaatgattttgctaacgtcacagaaaagcaacagtttgctaaacctgatcccccacattctgagtattttaaatcagtgaatttattatcaaactcagcaacatcttcaggaggtatcaatttaaacagaccaacttggatgaatgttcaaacaaaaaataacactcctattccttatcgaaatcaaggtaacttgatgaaattaaatagtcatttaagtgcagcttcaaaaggttctaaccattcttcagatttcccccaactatcatccacaaacttaaccccaaatagcaatttatttcagaaatattgccaagaaaacccttcagcattttctagttttgattttagttacagtggtgcagaaagaatccaatctgtcaatcacatagaaggactaacaaagcctggagaagaaaatctcttcaaattggttacggataaaaaaataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaagagagaaaaaagactgaattagcccttgccaagaattatcctggaaaaaaagtatccagtactaacaacactccagttccaaggctgacttccaacccatctagagttgatcgcttaattgtggatgaacttcgagaactagccagagtaagctgtaaaaatagataacagtggatggattttttgttaaatttttttttaagtttcaggccaggcgtggtggctcactcctgtaatcccaccactttgggaggccgaggcgggcagatcacctgaagtcaggagttcgagaccagcctggccattatggtgaaaccccgtctctactaaaaatacaaaaattagctgggggtggtggcatgcgcctgtagtcccagctacttgggaggctgaggcaggagaatcatttaaacccaggaggcagaggttgcagtgagtgaagatcacgccactgcactccagcctgagtgacagagcgagactctatctcaataaataaataaataaaactctcatcaagttttagagctttgaagggtttttaaatcacatttacatctaactctctgaaatatatttttttcatgtttggtcctagaactataatatttaggaaaggggctgggtgcagtggctcacacctgtaataccagcactttgggaagtggaggtgggagaatcacttgagcccaggagtttgagaccatcctgggcaacatagggagatcctgtctctactaaaaattaaaaattagctggacatggtgtcacatgcttatgctactcaggaggctgaggtgggaagatagcttgagcctgggatgtcagggctacagtgagccataaccacaccattgcattccaacctggggaacagagcaagatcttgtctcaaaaaaaaaaaaaaaaagaaaaaaaaagaaaaaggaaagggaaaatagtcccactcaatcattttaaaagtaattttcgtaatttaaatggttcctcttgaagctcaaattggcagtggagctaatcctcaactgaaagaattttttaaaaagcaaaaatcattttgagtattatttatggagaaagtctcatttctttgtcacatttgttttccagcttgatgagcaagctgtgcttacataagatggtaacttaatagggaattactatctttccttttttttttttttttttttgaggcgggtctcactttgtcacccaggctagagtgcagtggcatgatctatgctcactgtagccttgaccttctgggttcaagagatcctcctgcctaagcccccaaatagctgggactacagatgcacgctaccacacatatctaatttttgtattttttatagagacagggtttcgccatgttgcacaggttggtctcaaactcctgagctcaagcaatccacctgcctcagcctaccaaagtgctgggtgtgagccaccaccagtcaacaaaatacttttgttttggcgaagtaggatatgacttcaagtcaaatgttgtaaagaatcctcgttaagtcattttgtaatttaatgattattcctattctttataatttcagaattttctaagcaacttagggtaggtaaacttttccttttttgaccttcctctcttaaaaacttagttttccaaataaaatttgataaagattcttcctgggaaaaaaaaatgcagcaaaacggattacctcttttattgaataaaaccattttaggaattagaaaaatcaacatgggtcaaatttgtaaatctgtacaatgggatttatccatggtacattcagagcctaacatatgaggtacagccagatgttaataaaaacttcaatcttttattataaaaaaaaaaaaaaaa

SEQ ID NO: 27748 - DNA, 2093 bp, Homo sapiens
agtcacatagctgcgtggtacgtgactggaggtgtatccttgtcctcgtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccggagcaactgacaccaaaaagaagaaaataaatcatggcactaaccctgagacaaccacttcggggggctgccactcgcctgaggatacacaacagaaccgagcgcagctgaaagaagaaaagaaggcaagccaccaacatcaggaagccctaaggcgggagatagaggcccaggatcatacaatacgaattctcacgtgtcagaaaactgaactggagacagcgctctattacagccaggatgctgccaggaaatttgaagatgggaacctgggcaccccatcatccttcaacctggcactttcacaggcctttagggggagtcctttgggctgtgtctcaacctctctcattccaggagagtccaaggatctcgccggccgcttgcatcattcctggcactttgcaggagagttacagcgggctctctctgctgtgtccacacggcacaagaaggcagacaggtacatcgaggagttaacaaaggagagggacgccctgagtctggaactgtacaggaacaccataaccaatgaggagctgaagaagaaaaatgccgaactacaagaaaaacttccacttgcagaatctgaaaagtctgagatccagctcaacgtgaaggagctaaaaaggaaactggagagggccaagttcctgctgccacaggttcaaaccaacactttgcaggaggagatgtggaggcaggaggaggagctacgggagcaggaaaagaagatacggaagcaggaggagaagatgtggagacaggaggagagactgcgggagcaggaggggaagatgcgggagcaggaggagaagatgtggagacaggagaagaggctgcgagagcaggagaaggagctgcgggagcaggagaaggagctgcgggagcagaagaagctgcgggagcaggaggagcagatgcaggagcaggaggagaagatgtgggagcaggaggagaagatgcgggagcaggaagagaagatgtggagacaggaggagaggctgtgggagcaggagaagcagatgcgggagcaggagcagaagatgcgggaccaagaggagaggatgtgggagcaggacgagaggctacgggagaaggaggagaggatgcgggagcaggagaagatgtgggagcaggtggagaagatgcgggaggagaagaagatgcaggagcaggagaagaagacgcgggaccaggaggagaagatgcaagaggaggagaggatacgggagcgggagaagaagatgcgggaagaggaggagacgatgcgggagcaggaggagaagatgcagaagcaggaggagaatatgtgggagcaggaagagaaggagtggcagcagcagaggctgccggaacagaaggagaagctgtgggaacaggagaagatgcaggagcaggaggagaagatatgggagcaggaggagaagatacgggaccaggaggagatgtgggggcaggagaagaagatgtggcaggaggagaagatgtgggggcaggaggagatgatgcgagagaaggaggagaggatacgagatcagaaagagaagatgcaggagaggctgccagagcacgaggagcggtgctcagagccctgcctccctccctccaaagttctttgtaatatgagccacactggcagtgtggagcctgcaggaggagaggctggggagggttctccgcaggacaaccccactgcacaggagatcatgcagctgttttgtgggatgaagaacgcccagcagtgcccaggattaggcagtacctcctgtatcccattcttctaccgaggagacaagagaaagatgaagatcatcaatatctaaaagttggcactgtcaacaaggcctacagaagcataagccgccatgtcactgtgtgaatatagtctgagcacaaacttg

SEQ ID NO: 27749 - DNA, 5322 bp, Homo sapiens
gcttacgcgccccacttccgcttccggccccgggctgtggtgactggcggtgtggggtgggtcagagggcagtaggtacctccaggcgggagcagcgtttgcaccgcggtgggttcctgcgagctggtgcagaggggccccagcgggccggccccggggcacatgcgacgacctccacccctgggccccacgacggcctcagggcctgaaggcaatgtgcgaaacctgcagaagcggcaggcgccagggccaggcgcggcgggaggctgtggccctgaggccggggggtgccgggaaaataagcaaaagaggagaatggtggcccgggccacccctgggagaggcgaggtggaaagtgataagtcggttgcagcatcaggggctggaaaggccgcaaggcgtcaggtggaggggcgcaggggcccggtgagcccgtcagactcgtcagacccgcgaggcctagaagcagcaaaggaggctgaactccccttgcaaacggaaagacacaccaaggaaaaaagaaaagttactgaagcctcaagtgatgatccacagccagggcttgacttggtaagaaaggaatcattaaccagttcggaatctttccaaacagtggaatgcttgcagtctttgggtaaggaaagtataatagaaggtattaaaagaagaattcgaaataaaaaacttaaaagcttagaaaacccacctctcaaaataaccgaaaatgaggctacacaaaatattaaggttgaattccaagatgaactgtacaagaatactccaaaatattcttgtaatatcttgtcacctgaagtagaaaataattccgttttaaaattacgtgattgcaattgtttcccccattccaagggttgtaatgatgaaaacaacctgccatataaacctgatggtggatgtatgcatgtagcagaaaatttctcaaagaaagaaaaccttaggagtcttgcagagaagagtgacacaaatagtattcctcagctcttacaaacagaagaaaatgtaatgggagtaaataagttactaccagaagagagtgatttataccaaagtaaaaccaatggcttgctttcctgccttcaacatgaaaaaaataaatattcaatagaggagagcagtgttgggcgaaaacccaggaaaaggatgaagttgtctgaaaaagcagatgaaacagttactgagatgaacttctctaatgagtataacaagtctgagttgatgttgcaagaaaatcaaatgattgctgatggtaaagaagcagagactaaaagtcctttaaatgttttgagaaaagtaagccataatacagtctctttgatggatcatttattaagtgtcccagaaacagtagaaaaagaaacaagttctgaacatcatgtaaatgctgtgtttcagaaaaccattgaaccacttttgaaagaagaaacagagaatgcttcagagccgttaggttatgaaagcatggcatcgaaagaggattttaaatcgatgaaaagcttcatagggaaatcacctaatgagtaccatattgaaaggagatcttcacgggaagacttaagaagtgcatctgaagaattgaagttaagctgtcagagaacaatacctatgactggtaaaagaacttggccctattattcatgtgctagaatatctgcctggtgttggaaaaaggcttccttgccagaatcaagttactttcttcgtgggtctcaggaaagttgtaggcaagttgatgtccctaaacaccaaacaaaccagacccatttaactgactccaaattattattacaaagttccttaacagaaacaaacactgaatcttcaagtaaagaaaaattagattctaattctaattgtttgtcttcagtttctgcagtagaacctactttaatggttataaaggaacctataatcaaggatgataaaaagataaaatcagaggaactgagcagaagagggtcagaggtaatttctaacactactgaagatactcaattaaccagtgagactcaaagcttaacgggaaataaaaaaaaagctagaggaaatttaacgaaacttaatttgacagcgacttccaaagatggtcaggaagcaaataactctgcaggcaaaactattcatcgaaaagcatgcattgctcaacaaacatttatagttccagacttggttaaaatattgaacacaggacggctgactaattttaaaattcctttacttaagaataaatcagaaaaaagaaaagaagtaaatgccaagtcatcagagagagaagcttacagtcctctagaacttctggacaatttatctggagcagacgtaagacagaacaggagtaaagaaaatgtctccatgatgatgttaggacctcaaactttgagcatacgaaatagtgtaactccagtgcaagctagttctgactcattctacaataagaaatcctatagtatttctccaagctttacaaagcaaggtaacaatagcaaaccatctaatcacgtctctgaaccaggcaatattgtttctaataaagaagttgcttctctcacagttgaaaataatgctttttcttgtgatcctgggtatgtagagaaaagtccttccttctgctgtaatgaacaagaaacattccgaccagtgtccagtgaagttaggggtagaaaaataactaagaatttttcagaggtagggtttccagatattcttaaagcatatgaagatgacgtcctcttaattgatgtaattcaagatgacccagacctctttggagtctccaatgaaggggagctctcatttacttctgaggtcccaaagataagccaggagcccaatgttgctggagagcaccaatcaacagactccaagtacatggaaactccagtaaaaaaagaaccaagtgatgacttaagagaacttcctgtactggactgtggatggataaagccagacatctgtgcttccaactcagcagaaagtgaaataaaacgtgatcccaaagatgtaaacacttccttaggagaagttgctaatgagacctctgaaaatgaaacactgggagacttcagtgaacaaataaaaggttcagacttggatgaaaagcatagatttacagacaaagtgattaccaaagaagaaaaagaaaatatttatgaagtttgcaaaagcaaagattctagaaatgcagactttatggtcggcgaatgtcaatttgcagtaccagtcccgaaacctctgtgtttattagtacctcctttgaatctaagtggtcgtcaagaagacacaatactgaatacctggatgaatgatttcagatttctgggaaaacattctgtcctaaagctgcagaatcctgaaacttgtgaaatattcaagagggaaaaaaatgtgggggtgttccagaagtccctagggttgatgataccctataaatattgcaaatttcattttaatacattacgtggctgtgagcgaccactgtgcaagtttgctcatgtgcctgaacaaggggatgaaaaggtttgcatggatgtgtttaagaaatatataaatatcaatgaactgtgtttgctacagcgtgcagtaaacatatttatggagtactacagaaagtttcccccaggtgtatactttgatttacaagtgctaaatgaccttctaaattctttactcaaacattgtttgttgaaagaagtatttcagatagtgaacctcagcataatggttaaaatgctgccttctctgaaaatattactaaacatatttgagtatgtggcaactatgaaattaaggaatgctgtacctgctttaattgatatcttttgcaagcttgttgaagccgggatggtgcttgacccagagcactttaactatattgttaagcttttataccaagtacaagcttccaaacaagaaataactgcagttctggaaatgaaatcgaggttacagatgagacgatttaaaaagaactggaagtgtgatttagattcagccttgaataaattagagcattgtaaagaaaaaggtgactggaccaaattgggaaaattatacattaacgtaaaaatgggctgtgaaaaatttgcagatttccagacattttgtgcttgcattgctgaaacactcacaaaaaactatgaagatgaaagaccagatattcccttttgtgaatttgctgaaacagttagcaaagatccacaaaacagtaaagtagataaaggtgtactgggaagaattggaatcagtgctatgtacttctatcacaagctgttgcagtggtccaagggaaggaaggtcttagagaaactatatgaattaaaaatacactttacaagtttaaaaggacttatagggcctgagaagttagcatcaagatgtcaaattgtgaatgttgcagcagaaatttttctaaaaagtggaagcctagatggtgccatttgggtaatgagggagtcagagtggataatcaatacgcctctgtggccttgtgatagactggatgtgcttaatcgacataatttactctgtacaattgcacatgaaatcttagccaagagcctttatagacagacatttgaagttttgcagaatctaccaggttttcaaaattcccaagaaactgtggaagtctcacaatatagccttctttttaataagcttctaggttcctgtatagaaagcagtagtcttggtatgtcatcctctgtggcagaattcatgatttcaaagagcatccctattgatttttcctttctcagaagattaattacttctttaggaaggagtcgtttatggctcaaagccagagcccactacaaaagtgctctttccttgggttgctacccaccattggaaggaaatttataccgaaaacttcttctaattccatcttatttatctgagattgaaatgctcttagctattgaaatcttcatggtatctaatgctagtagtattcagagtcctggaacttctacacagatactgcagatagttttgaaaaggtgtgaagacaaccagtctcggagcaatgatgattatcaagctgcagtagaaaggttaattatggctgctcgtatatcagatccaaagcttttcgttaaacacatgactgtcaatgttaataaggaacaggtttatagtttggaacattgttctgccctgaaatggttaaaagagaatatgaagtgggctggaaaggtttggcttttcagtaaccattagctaataaagtctgctttttttttttttttagttcaagtaatcattgttgaaaataaaaggcaataaaaatagacagttttc

SEQ ID NO: 27750 - DNA, 5322 bp, Homo sapiens
gcttacgcgccccacttccgcttccggccccgggctgtggtgactggcggtgtggggtgggtcagagggcagtaggtacctccaggcgggagcagcgtttgcaccgcggtgggttcctgcgagctggtgcagaggggccccggcgggccggccccggggcacatgcgacgacctccacccctgggccccacgacggcctcagggcctgaaggcaatgtgcgaaacctgcagaagcggcaggcgccagggccaggcgcggcgggaggctgtggccctgaggccggggggcgccgggaaaataagcaaaagaggagaatggtggcccgggccacccctgggagaggcgaggtggaaagtgataagtcggttgcagcatcaggggctggaaaggccgcaaggcgtcaggtggaggggcgcaggggccaggtgagcccgtcagactcgtcagacccgcgaggcctagaagcagcaaaggaggctgaactccccttgcaaacggaaagacacaccaaggaaaaaagaaaagttactgaagcctcaagtgatgatccacagccagggcttgacttggtaagaaaggaatcattaaccagttcggaatctttccaaacagtggaatgcttgcagtctttgggtaaggaaagtataatagaaggtattaaaagaagaattcgaaataaaaaacttaaaagcttagaaaacccacctctcaaaataaccgaaaatgaggctacacaaaatattaaggttgaattccaagatgaactgtacaagaatactccaaaatattcttgtaatatcttgtcacctgaagtagaaaataattccgttttaaaattacgtgattgcaattgtttcccccattccaagggttgtaatgatgaaaacaacctgccatataaacctgatggtggatgtatgcatgtagcagaaaatttctcaaagaaagaaaaccttaggagtcttgcagagaagagtgacacaaatagtattcctcagctcttacaaacagaagaaaatgtaatgggagtaaataagttactaccagaagagagtgatttataccaaagtaaaaccaatggcttgctttcctgccttcaacatgaaaaaaataaatattcaatagaggagagcagtgttgggcgaaaacccaggaaaaggatgaagttgtctgaaaaagcagatgaaacagttactgagatgaacttctctaatgagtataacaagtctgagttgatgttgcaagaaaatcaaatgattgctgatggtaaagaagcagagactaaaagtcctttaaatgttttgagaaaagtaagccataatacagtctctttgatggatcatttattaagtgtcccagaaacagtagaaaaagaaacaagttctgaacatcatgtaaatgctgtgtttcagaaaaccattgaaccacttttgaaagaagaaacagagaatgcttcagagccgttaggttatgaaagcatggcatcgaaagaggattttaaatcgatgaaaagcttcatagggaaatcacctaatgagtaccatattgaaaggagatcttcacgggaagacttaagaagtgcatctgaagaattgaagttaagctgtcagagaacaatacctatgactggtaaaagaacttggccctattattcatgtgctagaatatctgcctggtgttggaaaaaggcttccttgccagaatcaagttactttcttcgtgggtctcaggaaagttgtaggcaagttgatgtccctaaacaccaaacaaaccagacccatttaactgactccaaattattattacaaagttccttaacagaaacaaacactgaatcttcaagtaaagaaaaattagattctaattctaattgtttgtcttcagtttctgcagtagaacctactttaatggttataaaggaacctataatcaaggatgataaaaagataaaatcagaggaactgagcagaagagggtcagaggtaatttctaacactactgaagatactcaattaaccagtgagactcaaagcttaacgggaaataaaaaaaaagctagaggaaatttaacgaaacttaatttgacagcgacttccaaagatggtcaggaagcaaataactctgcaggcaaaactattcatcgaaaagcatgcattgctcaacaaacatttatagttccagacttggttaaaatattgaacacaggacggctgactaattttaaaattcctttacttaagaataaatcagaaaaaagaaaagaagtaaatgccaagtcatcagagagagaagcttacagtcctctagaacttctggacaatttatctggagcagacgtaagacagaacaggagtaaagaaaatgtctccatgatgatgttaggacctcaaactttgagcatacgaaatagtgtaactccagtgcaagctagttctgactcattctacaataagaaatcctatagtatttctccaagctttacaaagcaaggtaacaatagcaaaccatctaatcacgtctctgaaccaggcaatattgtttctaataaagaagttgcttctctcacagttgaaaataatgctttttcttgtgatcctgggtatgtagagaaaagtccttccttctgctgtaatgaacaagaaacattccgaccagtgtccagtgaagttaggggtagaaaaataactaagaatttttcagaggtagggtttccagatattcttaaagcatatgaagatgacgtcctcttaattgatgtaattcaagatgacccagacctctttggagtctccaatgaaggggagctctcatttacttctgaggtcccaaagataagccaggagcccaatgttgctggagagcaccaatcaacagactccaagtacatggaaactccagtaaaaaaagaaccaagtgatgacttaagagaacttcctgtactggactgtggatggataaagccagacatctgtgcttccaactcagcagaaagtgaaataaaacgtgatcccaaagatgtaaacacttccttaggagaagttgctaatgagacctctgaaaatgaaacactgggagacttcagtgaacaaataaaaggttcagacttggatgaaaagcatagatttacagacaaagtgattaccaaagaagaaaaagaaaatatttatgaagtttgcaaaagcaaagattctagaaatgcagactttatggtcggcgaatgtcaatttgcagtaccagtcccgaaacctctgtgtttattagtacctcctttgaatctaagtggtcgtcaagaagacacaatactgaatacctggatgaatgatttcagatttctgggaaaacattctgtcctaaagctgcagaatcctgaaacttgtgaaatattcaagagggaaaaaaatgtgggggtgttccagaagtccctagggttgatgataccctataaatattgcaaatttcattttaatacattacgtggctgtgagcgaccactgtgcaagtttgctcatgtgcctgaacaaggggatgaaaaggtttgcatggatgtgtttaagaaatatataaatatcaatgaactgtgtttgctacagcgtgcagtaaacatatttatggagtactacagaaagtttcccccaggtgtatactttgatttacaagtgctaaatgaccttctaaattctttactcaaacattgtttgttgaaagaagtatttcagatagtgaacctcagcataatggttaaaatgctgccttctctgaaaatattactaaacatatttgagtatgtggcaactatgaaattaaggaatgctgtacctgctttaattgatatcttttgcaagcttgttgaagccgggatggtgcttgacccagagcactttaactatattgttaagcttttataccaagtacaagcttccaaacaagaaataactgcagttctggaaatgaaatcgaggttacagatgagacgatttaaaaagaactggaagtgtgatttagattcagccttgaataaattagagcattgtaaagaaaaaggtgactggaccaaattgggaaaattatacattaacgtaaaaatgggctgtgaaaaatttgcagatttccagacattttgtgcttgcattgctgaaacactcacaaaaaactatgaagatgaaagaccagatattcccttttgtgaatttgctgaaacagttagcaaagatccacaaaacagtaaagtagataaaggtgtactgggaagaattggaatcagtgctatgtacttctatcacaagctgttgcagtggtccaagggaaggaaggtcttagagaaactatatgaattaaaaatacactttacaagtttaaaaggacttatagggcctgagaagttagcatcaagatgtcaaattgtgaatgttgcagcagaaatttttctaaaaagtggaagcctagatggtgccatttgggtaatgagggagtcagagtggataatcaatacgcctctgtggccttgtgatagactggatgtgcttaatcgacataatttactctgtacaattgcacatgaaatcttagccaagagcctttatagacagacatttgaagttttgcagaatctaccaggttttcaaaattcccaagaaactgtggaagtctcacaatatagccttctttttaataagcttctaggttcctgtatagaaagcagtagtcttggtatgtcatcctctgtggcagaattcatgatttcaaagagcatccctattgatttttcctttctcagaagattaattacttctttaggaaggagtcgtttatggctcaaagccagagcccactacaaaagtgctctttccttgggttgctacccaccattggaaggaaatttataccgaaaacttcttctaattccatcttatttatctgagattgaaatgctcttagctattgaaatcttcatggtatctaatgctagtagtattcagagtcctggaacttctacacagatactgcagatagttttgaaaaggtgtgaagacaaccagtctcggagcaatgatgattatcaagctgcagtagaaaggttaattatggctgctcgtatatcagatccaaagcttttcgttaaacacatgactgtcaatgttaataaggaacaggtttatagtttggaacattgttctgccctgaaatggttaaaagagaatatgaagtgggctggaaaggtttggcttttcagtaaccattagctaataaagtctgctttttttttttttttagttcaagtaatcattgttgaaaataaaaggcaataaaaatagacagttttc

SEQ ID NO: 27751 - DNA, 1645 bp, Homo sapiens
ataacaacataggaacaggtcacccgcgtgttactcaaaactgtaggacggcagtgagggctttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgcccaccactgccaaggcgctctccgatgacgagcagggtggaagcgccttcgtagcccagagccatggtgcaaacagagtgcatctctccagcgaggctgaggagcatcacagagagaaactccaggaaatcctgaatcttttgcgtgtaaggagaaaggaagctcaggctgtactaacccatgagaaggagagagtgaaactgtgccaggaagaaacaaagacttgtaaacaggttgttgtgtcagaatacatgaaaatgcaccagttcctgaaggaagaggagcagctgcaactccagctactagaacaggaagagaaagagaacatgaggaagctgaggaacaatgagatcaaactgacccagcaaatcagaagcctaagcaaaatgatcgcacagattgagtcctcaagtcaaagctcggctttcgaatctcttgaggaagtgagaggagccctggaaaggagcgagccactcttgcttcagtgtccagaggccaccaccacagagctgagtctgtgccgcatcacgggaatgaaggagatgctaagaaaattcagcacggagataacgctggacccagccacagctaatgcctatctcgtgttgtcggaggatctgaagagtgtgaaatatgggggaagcagacagcagctacccgacaacccggaaagatttgaccagtctgcgactgtgctgggtactcagatcttcaccagtgggagacactactgggaggtggaggtgggaaacaagaccgagtgggaagtgggcatctgcaaggactctgtgagcagaaaggggaatctccccaagccacctggggacctgttctcactaataggtttaaaaatcggagatgattacagcctctgggtctcgtcacctttgaaaggtcagcacgtcagagagcctgtgtgtaaggttggtgtcttcctggactatgaatctggacatatagcattctacaacgggacggatgaatccctcatctacagcttcccgcaggcttctttccaagaggccctcaggcctatcttttccccctgcctcccaaatgaggggacaaacacagaccctctcaccatctgctcactgaacagccacgtctgaggggcgtgccctgagccgtcacagcgggcgatgtctgagaccaagacacaactattaagacgatgaaggcatcgacagtattaatgtcaggtgatctgaaataaactcccgtaaccccacccc

SEQ ID NO: 27752 - DNA, 8704 bp, Homo sapiens
gaggctttgcggtggctgcttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagctggcagtctacgccacgaggaagacccgtagcgtcaggagccaggaggaccagtggtacttgggctacccgggggaccagtggtcctcgggcttctcccacagctggtggaaaaatagcgtcggcagcgagagcaagcacggtgagggcgccttagaccagccccagcacgacgtccgcctggaagatcttggcgagctccacagagctgcccggtcgggcgacgtccctggggtggagcacgtcttggctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttggtgataaaagtccatctgtatcaccatcaatgcctgaaaatcagtcagcaaccaaagaactgggacagatgaacttaacagaacgagaaaaaatggacattggagttgtacttctctcagggaatgatactctccatgacctgtgccaatcacagctaccagaaaacaaagagagcaaagaagcagaacaagacttggagctgacatcagaggaagagcaagaaggacttaaaggatgcgaaaataagcagccacagaaaacgtctcaagaaccagaaatggctaaggattgtgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtgaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccgtactctgggtcccaggaacatgtttgccagtcatcttctaagcttcatttacatgaaaataaattagactgcgacaatgataacaaactaggcattggacatatttttagtacagataacaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatgaagagcatgacaggcctgcagataaaacagctaatgaaaagaacaaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacaagtaaacaaaaggaactagaaatggctcaaaagaaaatgaattctgagatttctcataggcatcagaaagaaaagcatctctttcatgaaaattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactggctgctgctgtacgtgactgtgatcaaagtcagacagcaagagacctaaaacttgatttccagagaacaagacaagagtgggttcgtttacatgacaaaatgaaggttgatatatctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcggccaaacacagtgtcagaagaaggaaactgaacaaatgtaccaaattgaacaaagcaaactgaagaaatacattgccaagcaggaatctgtagaggagagattatctcaactacaaagtgaaaatacgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtgaaggtgaacggcataaactgttgattgaagaaagagcaaggaaggagatacaagaaaaattaaacgaagccgttctcaccttgcagaaacaagcagcagtatctcatgaacagttagcacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtaaaagttagagaatccttgtcaaatgaactcagtagaactaatgagatgatagcagaggtcagtacgcaacttactgtggagaaagagcagaccagatccagatctctattcactgcttatgctacaaggccagtcctaagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagagtatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatgtagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagcttcccccctgtgggccatttgagagtaaattgctgacattatgccatcacatctggtatgtgggtattcccacaagtcaggacattttatataactacttcataatcagaaagttaacatcaatacacttgatcatttaattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaactttttttatgataagatttagatgataattttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaatatgtgccatggtggtttgctgcacagatcatcccatcacctaggtattaatagtagcccagcatccattagctgttcttcacgatgctctcccttctctcacccgccaccatcccacatgcccctgtgtgtgttgttccccgccatgtgtccatgtgttgtcattattcagctcccacttgtaagtgagagcatgcagtatttcattttctatttctgtgttggtttgctgaggataatgttctgcagctccacccatgtccctgcaaaggacatgtctcattccttttcatggctgcatagtattccatggtgtatatgtaccacattttctttatccagtttatcattgatgggcttttaggttgattctttgtctttgctgttgtgaatagtgctgcaatgaacatacgtgtgtgtgtatctttatactagaattagttatattcctttgggtatacaccaagtaatgggattgctgggttaaatggtatttcaggttctagatctttgaggaatcaccacactgtcttccacactggttgaactaatttacactcctatcaacggtgtaaaagcattcctgtttctccataatcttgccagcatcttttcagttttttgaattatagccattctgactgttgtgagatggtgtcttgttgtggttttgatttgcatttcttagatgatcagtgatgttgaggtttttttgtttgttggctgcatgtatgccttcttttgaaaagtgtctgtttgtgtcctttgaccactttctaatggggttgagttttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttctttcaggatttttatagttttgggttgtagatttaagtctttaatccatcttgagttaacttttgtatatgggttaaggaaggggtccagtttcaatttgctgcatatggctagccagttctcccagcaccatttattaaatagggaatcttttccccattgcttccttttgtcaggtttgtcaaagatcacatggttgtaggtgtgtggtcttatttctgggttctctattctgttccattggtctatgtgtcggttcttgtaccagcaccatgctgttttggttactgtagtcttgtagtatattttgaagctgggtagcatgatgcctctagctttgctcttcttgcttaggattgtcttggctatttgggctctgttttggttccatatgaattttaaaatagctttttctaggtctgtaaagaaggtcaatagtagtttaatgggcctagcatttaatttacagattgctttgggcagtgtggtcattttcacgatattgatccttcctgtctgtgagcatatgtttttccatttgtttgtgtcatctctgatttctttgaataatggtttatagttatccttgaaaaggtccttcacttttcttgttagctgtattcctaggtattatactcttcttgtggcaattgtgaatgggagttaattcatgatttttctctcggcttgcctgttgttggtgtataggaatgctagtgacttttgcacattgattttgtatcctgagactttgttgaagttgcttatcagctaagaggtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagagagggcatctttgtcttgtgtcagttttcaagggaacgcttccaggttttcaggtactcaggcaacaaatagcgctacgaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttggcaacacaataatagtgggggatgttaatactccgctggcagcactaggcagatcaccaagacagaaagtcaacaaagaaacaatggacttaaactataccctagaacaaatggacttaacagatacttacagaacattctacccaacaagcatagaatatacattgtatacatcagaacacgggacattctccaaaatagaccatatgatagggcacaaaacaagtctcagtaaatttaagaaaatcagaattatatcaagtactctctcagaccacagtggaataaaattggaaattaattccgaaaggaacactcaaaagcatgcaaatacatggtaattaaataacctactcctgaatgattgttgggtcaacaatgatatcaagagggaaatttaaaaattctttgaactgaacgataatagtgacacagcctatcaaaaactctgggatacagcaaaagtggaggtaagaagaaaattcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatgaaaaaaaaaaaaaaaaaaa

SEQ ID NO: 27753 - DNA, 2428 bp, Homo sapiens
gttacttcatagcattctgaagacctgtccaccaattacagggctccttactggaaaaaccaactgctggggagtgccaagagaccctagcaacaccctgcagcgtttgaaatctgaggggaaaagactgtagtcagcccttagtggatgagagcgcctatgctccagaaacagcaggctcccaggatggacaccccgccccctgaagaacgcttagagaagcaaaatgaaaaactgaacaaccaggaagaggagacggagtttaaggaactggacggtctgagggaagccttggcaaacctccggggactgtcagaggaggagaggagcgagaaggctatgcttcgctcccgcattgaagagcagtcccagctcatctgcatcctgaagcggaggtcagatgaggccctggagcgctgccagatcctagagctgctcaatgcagagctggaggagaagatgatgcaggaggctgagaagctcaaggcccagggtgagtacagtcggaaactagaggaacgctttatgaccctagcagccaaccacgagttgatgctccgcttcaaggatgaatacaagagtgagaacatcaagctgagggaggagaatgagaagctgaggctggagaatagcagcctcttcagccaggctctgaaggatgaggaggcgaaagtattacagctcacagtccggtgtgaggccctcactggggagctagaaacgctgaaggagaggtgtgctcaggatgcctgccaggcacaggcgcgcgagaaggagctgctggagctacagagccagcaggcctgcacccacaccaaggagacagaacagctgcgcagccagctgcagaccctcaagcagcagcaccagcaggctgtggagcagatagctaaggcagaggagacacacagcagcctgagccaggagctgcaggccaggctgcagaccgtcactagagagaaagaggagttgctgcagctgtccattgaaaggggcaaagtgcttcagaacaaacaggcagagatctgccagcttgaggaaaagttggagatagcaaatgaagacaggaagcatgcgctggagcggtttgagcaagaggcagtggctgtggacagcaacttgagagtcagggagcttcagcgcaaagtagatgggatccagaaggcctacgatgaactcaggctgcagtctgaagccttcaaaaagcacagcttggatcttttaagcaaggagagagaactcaatggcaaactccgccatctctctccatagggaagtttctgcttcctctggcctgcaattcagaattcaaatatttgcgtcttagcattatggcaagagtaaagatgatatcccatttattatactttcaagcacaaaaggcaactcaaagaaaagctactttactatgatattgttgttattattgtaaagccattattaattttcatttctacacctagaatacacaagatttgccagatttccttctgtgccttagaaatcttaaatttactagtagtatcttctcctacccataagttattaattctcaacctcagatatcttcatttatgttaggattttaaattagcagcttctatgatttaagtcaatctaagtgcagtgagatgtgccattgtgaaaaataattagcacaattacccactgtagatagttaggcttatagtctcccatagttgagattgtaagcaaacatgtatcagcataatagcatgaatgctttgcagaaaaaaaaaagtgtctgactttattttattttgcgctagcttggaaaatgattgagatcaagttctttaacaaagaaggtcaattttattctgtatgagcaatatgattcaaataagttatacaaaacaacttttattttttctgcaagcttagataatattccattttttggttttctctttaaaaagaggatttagatgtgcaataatgcaaatatcagtagcttaatttaatattgcacgatatgctaatagacaattagacaatttggggtaacaaatcatagcagacgtgatctatagagtaactcagaaattgttttgtttctattagcatattttttgtaattaagattttccttttttaaaaaaatctaagctgaacgtgtgtatgtatgcttgcagcatttttgtagtaatacctacattttgtaagaatagttataaaaacatgatatatatatatgtaaagttcttaaaaaagttctcaaaggtagttatattttcttatcttcctgtaattaggtattgatatataaacattattatgaatacctctcaaaatagattgtaatgtaatatttttctcacccattttgctgaaggctaccaagttacataatgaatttacttaaaaaatatgacttggtgcctttttagtaaaaccatttccaagc

SEQ ID NO: 27754 - DNA, 7398 bp, Homo sapiens
atggcccagatccaaaaggataaagcaaatatttcagagaaaagtgtaatgcatcccgagtacatagctgtaaaggcagagaaatcacccctttcccatatactaaaaacaaaggaactgcaggtgaacatcagtcaacaaggggaaaaggcacaagaaggtgaggtggaaatagttgtacttctgagcaaaacttgtccttttgtcacttcttcagctttccttgagttagactcaataaaagaagaggaaggtgaaccacgaataacaagaagctttatgccacatcttgagatccaggaatcattgccttcaaggcaaacagcacctacaaagccaacagagagccttgtaaagaaagagaaacaactccttccacagaaagaagacagagtacaaacagtatccatgcatggcctgatgcaccccaatggtgccgttttcaaggcaaagacatcagcacctccacaagtgttcagcatcactgagcacagtcctctgagtaagagaaaggagccacagtggggcatgaaagagagagcaggacagaagcaggacaggacaggacgtcctcatgtgattctgacaaaaactcatccattcatgccttctctctctcaccatagattctctccttcacaaccaaagcttcctatatcatcaggtgcaggaaaaagcagacttgcaaattcaaatgaaggtattagctcacataaagtaatactaaaagcaaaccaacaaatgccatataaagaggcaaaggacagagtaaaaatagaaggcagggaaggtagaatactccccaaaaggatacatttgagggcagaggcactcccacttgcacttctatgcaatggaaagaactactctttgcacattgaagagcaaggggaaggagtacaggaaagcaaaaaggaacctggagtggttccgaggaaatctgcttcattccctcctcctccattttacctgaattgtgacactagaaggaatgaaaaggaaggcacattaggaaaaacacaattcagttttccaccactaaagattcaggattcatcagattcaggcaaaaaagcatatactgagtcactgcatggttacacattaagcaactcaaaaggaccagtgcaacccacagcacagggagaagagaaaggtggactcagaatagatatggaagacaaaatgctccccaaatgtacagacctgaaagcaaagcaattactactctcagatatactcaataccaaaaaattgcagtggaaaagtaaagaacaaaagagaaagattcaggaagataaaaataaacaagttaaaggactgccaagcattaatacttctttacttactccaccatatcttaagtttgatacaacagaaggacaggagaacgtgataagaattgcaaaagtgtctctcccacagtcacggtccaaggaatcatcagatgcagggagaatagcatgtccagaagcaacccatggagaactttcaagtgatgtaaagcaattaaaagcacacctgctacagaaagaagagaaggatagagaaaaagttgcggatatgaccagtgtactggatcccaacaaaatgtatttgaaggcaaagaaatcgcctgtcttacatacgcacagtttcagtgatcttcagtggaaaactagagagcaagaggaggaaaaggtccagaaagttaaaagtgggccaggtgtcatgttgtctaagagtccttctagatcctccccacttcaccttaatgtgaatacagggtttcaggaggaaagcataccaatattaacaagaccctcttttcccctagtaaaactccaggtatcaccagatactgagggaggcacatgtataaggccaattgctggtgatattttaatctatctacaaaaaggaaaacatgtgtcacagaacaaggaagaggatgacgtgcaaatagtaagcatcttaatattccccaaacatcaggaagagaaggtgcaggaatgtgaaggtgaaccaggtgtggttctgaccaaatctacttcattgccatctctatctcaactagaattggataaagaaacacatttaggtaatgaaatgctaagacttaaaagacctattttgcggagaatatcacacataggggagactgtacatagagagtccgtcgttggtgatatcccaaaagataggaaccaaaaaaaaataatcgatatgagaggcacagatataactttgaagtcaaagaagtcacctcgttcctgtatgctccacagaacagaactgcatgtgaacattggagggcaaggacgaaaggaacatgaaggtcaagataaaccaccaggtatgattcaaagaaaaatgtgcatactcttttccaaacctttgccatctaaccttaaactggagagagctacgcatgcagatgaagaaaggcttggaggtaagacatcctttgtacttccactaatgccatcagcattaccagatacagagaaaacagcagatgcagaggcaaggagtggtgatgtaagaaaaggaaaaccacataggtcacagaaagaaaacaggcatgaagtgaaaacgatagatatgaggttcaggatacactgccaagaggcaaggatttcaccaatgtcacatatccttaatgcaaaggaattagtgttgaatattaacaaactggagaaaaaagtacacaaagataaagatgaagcatgtgtggttctgtcaaggacttttctttctataccgtcagcacctcctctttatctggattcagggaacaaaacagacaaagacactccaggaattacaggatcatcttgtccacagcgaactctccatgtaccctcaaatacccagaaaataacaaatagagactcagttgaaggcgttgataaaaacgttgttaagcaagcagaacagtatgtgccccgcccagaggcagagcaacagttgacctcaaacttcatgatcagcgtccagcaaaggaaccaaccttcacgagtcaggtcagaagaagatttgaatcagttagttttaaactcacgggatgaggacatttatttcacagggtttggtaccataagaagtgggaaaaggccggaatggctctttacagggaaaaaggctcagcctgtaaaatacaaaacagaaactttaactgcgtttctttcctatcccacaatggatgcaactaaaatgggaggtctggaagaagacactgaaataatggataacttaaaccataaaatcagtcctaaggcttcagtttcactgataaggaaaatatctaaggaactgtatgtcacacttggcacccctgcaaattcaaaaggattttctgtttcagagagatacgctcaccagcaagaaacttcatcgaaagtatctccagaacttgcaggttcatgtaaatttgataagccaaaggaagatggacaaagtaatgatagaatcagcaaaatgttttctcccaaagtgttagcaccacagacaaagggatcactcaaaaaaataagtatcgtcaccaactggaatgccccccaaaatatagaagaacaagatattgtcatgaaaaagcaagtgatccgacggtgtgaacatgggcacaagaccaggacgaacactatcctttctaagtttccccttcaaagtggaaagcagaagacaccatcggaaacagatgtggacaagaaaacaacagcgcacctcagcctacagatgctaccaggaatacacatggatatgacagagattgaccctgcaaaagggggaaggaagcaggcattgctcatttcagaacaagaggaaggtgttctggaatttcttccgaagtccctattccctccctggacttttcaatttcaatcaggggatctggaggaaaaacatcaaacagacgcaaacaccaatataaatctagagcagaaaaaattagaaatggacaatgatagtactgtgaatcagaaagaagggaaattaaaaataggcacaaacagagctttacatctgcaagaagagaaaacagagatgcacaaggccaggactgccaatctggagaaggagagaggaagaatggacacaagcagtagtgcacacccgcatcttctatctctaaaggcagaggaatctcaaatgaagactcaagtcatcactcatagggagaacagccgcctaatcatgcaaaagcagaaaaaagaactagaagcatctaatgcaaaacaaagcattcaactacaaaaattatttcaaagaaatgttctggattcattttattcatatgttcctctttctcccaaacgtaaagatcagaaaggcagattaacaataagagatctgaaaagagaattgagcaccaaatatttaactatgaaaatccagaatcacccaattccacagatgcttaatatcacggggcgtggtacaccaagcaatagaaagaaattagagtatgatgttaagttaaagaacatagcttcgtggagtaaagatgtctcaggaatatttatcagaagtctttctatttccatcatgcgttcacctcacactgaccctaagacaaacctagaaagagaaaagagaatctgtcttcctaaattccaggaaaaatcaccaaacactagtgaaatgtctaagagagacactttaacaattgtaaaaggggaacagaattttacaaacacagttccacaagatccccagccctttgcagtggacaaacaacaaatgcagaaacttcctaatgtcaaatcagaagcaaacctcagaagtgaaatgaataaaaaatacttaaaggcacaaacaaaagaacggattgttccagagcatgatgtctcaaggatcattaaaaaaccagacttacgtatcatcgagcaggaagaaaagattctaaaacgcattctgacacccacagagtgtccatctatgcttgaagatccaaagttacccaagcaaagggatcagagtgaaccagtatgggacatgaccacacaaaaggttcagcagcaaaaagctttcccaggaactgtgcccataccgcctcaagttaaaagtagcgaagtcaaaatagttgcagacagtacaaatgcagaacatttacttcccatttgtgaagcaaccaaagctatctctgagtcccaggttaaaaatatgatccaagacaaagtttcttctgataaactagataacatacaagcctataagcctgacgacttgaagtcaccaccttttccagagggtccagatacaatatcaacagcaatatatcccaaaacgcagcacaaatcccttttagaacagtttactcccaaagaaaaaaataagcttactagtcatttagagtcaaaagcacttgaaatacaactgaatctgataccagagatggcaaggaaatctttacaaatgttcaacttttatccaaaagggactatttcaaaagataacagttggaggttctattctagacataaaacaatgaactttatgtctctagaagggactgataccatagaacctaactcaaaacataaacaccaaaaggattcacctcttgccagcaatatgaagacactgattgttgatgtttcaagtgacagtgaggagacaatcacaaagctacagagtattaataagctagaaaatggaacatctgcagtgacttctgctagtgagatgctattgcctcataccctccaaaaccactcagtaaaagaaaaaggcaaactcctcatgcacttttctgtgaaaacattggagatacaaatgaaagcctttcccagaattgtaagagaatcttatgcaatgaccagtgctcatgagagaaagaaacccttatctaactgtattcatcctggtttcacaggaccaaaacgacaaaacagaattttgttactttctgaggagaaatctctccatcaaatagatcttgatttacaatacaaataccttcgttttctcctggggcttcctgttggaagtacgttccctaagccaaatgtacttcccaaacatagtaagttaaacacaattgcagtgtgtaaaaacgtaaatgctggtggacaaagtggtagtctttccattgatacagaactgttagaacaacatatttctttcaaaaagcaaagtccccatgaaaactcatcactcatcagaaaattcccacagccaacccttgtgtgtgcttctgaccgtgatctgcacagcccgaggaagaaagatactcaagttctttcagagtcagaattccatgtgactccagaaaaaaacaaacaatatcatgtatggtttcaagaaagaaatacatgtgaatctgttgatttaaggacccagagaaatgctactggttcagctgtttcatgtgaaactcagatttctgaagattttgttgatattcagacagatattgagagtccagctgacttggacgagtgttcatgtcttgaagtaagtgagagtgaggaatgtgtgtttctggaagccaactcttatttaagtcaggaatcagaaaacattctatttgaattacagacaggcattcctttggaaaatgtctacaaaatcacgactgatttgaaatcattttacagtgaagattcaggttcccattgtactagagagtgcagaaaggaaaccttaattattacaccaccttcctgtaagtcccacaaaagcaggaaatatagatcatcttccaaaatgaaatctcctgactggttgtgtcatagttcatcaaatactgcggaaattcagtctaggtcatctagtgtatcattcagtgaagagaagatttcatggactaccaagagcagaacaagttactcttcagctcccttaactgaatcaaatattaaatcacatcttgcaaaaaaccaaggcaagtctcacaggcacccagaaagccaagaaagaaagaaggccagatctgatttatttaggaagaacagcagtcattgggaccacgattacagttgtacacacagcaaagggaaacgtgacagaaagaagagagtgtatgattatgagtcagaaagattggattgtttccaaagcaaacataaatcagcatcaaaacctcatcatgacgatatcaacttctattctgaaagaaaacaaaaccggccctttttttttgcctgtgtaccggcagactcactggaggttatacccaaaaccattcgctggactattccccctgaaaccttaaggaaaagaaacttcagaattcccctagtggcaaagatttcaagttcttggaatatatggagttcctccaaaaagttgttggggtcgctctcggggtcccttactaccgtttttcatagctgacattaccatagctaaactcctctgaagtggacagctggtcgctattgtgatattctgtgaaaaatacaatcatataac

SEQ ID NO: 27755 - DNA, 7398 bp, Homo sapiens
atggcccagatccaaaaggataaagcaaatatttcagagaaaagtgtaatgcatcccgagtacatagctgtaaaggcagagaaatcacccctttcccatatactaaaaacaaaggaactgcaggtgaacatcagtcaacaaggggaaaaggcacaagaaggtgaggtggaaatagttgtacttctgagcaaaacttgtccttttgtcacttcttcagctttccttgagttagactcaataaaagaagaggaaggtgaaccacgaataacaagaagctttatgccacatcttgagatccaggaatcattgccttcaaggcaaacagcacctacaaagccaacagagagccttgtaaagaaagagaaacaactccttccacagaaagaagacagagtacaaacagtatccatgcatggcctgatgcaccccaatggtgccgttttcaaggcaaagacatcagcacctccacaagtgttcagcatcactgagcacagtcctctgagtaagagaaaggagccacagtggggcatgaaagagagagcaggacagaagcaggacaggacaggacgtcctcatgtgattctgacaaaaactcatccattcatgccttctctctctcaccatagattctctccttcacaaccaaagcttcctatatcatcaggtgcaggaaaaagcagacttgcaaattcaaatgaaggtattagctcacataaagtaatactaaaagcaaaccaacaaatgccatataaagaggcaaaggacagagtaaaaatagaaggcagggaaggtagaatactccccaaaaggatacatttgagggcagaggcactcccacttgcacttctatgcaatggaaagaactactctttgcacattgaagagcaaggggaaggagtacaggaaagcaaaaaggaacctggagtggttccgaggaaacctgcttcattccctcctcctccattttacctgaattgtgacactagaaggaatgaaaaggaaggcacattaggaaaaacacaattcagttttccaccactaaagattcaggattcatcagattcaggcaaaaaagcatatactgagtcactgcatggttacacattaagcaactcaaaaggaccagtgcaacccacagcacagggagaagagaaaggtggactcagaatagatatggaagacaaaatgctccccaaatgtacagacctgaaagcaaagcaattactactctcagatatactcaataccaaaaaattgcagtggaaaagtaaagaacaaaagagaaagattcaggaagataaaaataaacaagttaaaggactgccaagcattaatacttctttacttactccaccatatcttaagtttgatacaacagaaggacaggagaacgtgataagaattgcaaaagtgtctctcccacagtcacggtccaaggaatcatcagatgcagggagaatagcatgtccagaagcaacccatggagaactttcaagtgatgtaaagcaattaaaagcacacctgctacagaaagaagagaaggatagagaaaaagttgcggatatgaccagtgtactggatcccaacaaaatgtatttgaaggcaaagaaatcgcctgtcttacatacgcacagtttcagtgatcttcagtggaaaactagagagcaagaggaggaaaaggtccagaaagttaaaagtgggccaggtgtcatgttgtctaagagtccttctagatcctccccacttcaccttaatgtgaatacagggtttcaggaggaaagcataccaatattaacaagaccctcttttcccctagtaaaactccaggtatcaccagatactgagggaggcacatgtataaggccaattgctggtgatattttaatctatctacaaaaaggaaaacatgtgtcacagaacaaggaagaggatgacgtgcaaatagtaagcatcttaatattccccaaacatcaggaagagaaggtgcaggaatgtgaaggtgaaccaggtgtggttctgaccaaatctacttcattgccatctctatctcaactagaattggataaagaaacacatttaggtaatgaaatgctaagacttaaaagacctattttgcggagaatatcacacataggggagactgtacatagagagtccgtcgttggtgatatcccaaaagataggaaccaaaaaaaaataatcgatatgagaggcacagatataactttgaagtcaaagaagtcacctcgttcctgtatgctccacagaacagaactgcatgtgaacattggagggcaaggacgaaaggaacatgaaggtcaagataaaccaccaggtatgattcaaagaaaaatgtgcatactcttttccaaacctttgccatctaaccttaaactggagagagctacgcatgcagatgaagaaaggcttggaggtaagacatcctttgtacttccactaatgccatcagcattaccagatacagagaaaacagcagatgcagaggcaaggagtggtgatgtaagaaaaggaaaaccacataggtcacagaaagaaaacaggcatgaagtgaaaacgatagatatgaggttcaggatacactgccaagaggcaaggatttcaccaatgtcacatatccttaatgcaaaggaattagtgttgaatattaacaaactggagaaaaaagtacacaaagataaagatgaagcatgtgtggttctgtcaaggacttttctttctataccgtcagcacctcctctttatctggattcagggaacaaaacagacaaagacactccaggaattacaggatcatcttgtccacagcgaactctccatgtaccctcaaatacccagaaaataacaaatagagactcagttgaaggcgttgataaaaacgttgttaagcaagcagaacagtatgtgccccgcccagaggcagagcaacagttgacctcaaacttcatgatcagcgtccagcaaaggaaccaaccttcacgagtcacgtcagaagaagatttgaatcagttagttttaaactcacgggatgaggacatttatttcacagggtttggtaccataagaagtgggaaaaggccggaatggctctttacagggaaaaaggctcagcctgtaaaatacaaaacagaaactttaactgcgtttctttcctatcccacaatggatgcaactaaaatgggaggtctggaagaagacactgaaataatggataacttaaaccataaaatcagtcctaaggcttcagtttcactgataaggaaaatatctaaggaactgtatgtcacacttggcacccctgcaagttcaaaaggattttctgtttcagagagatacgctcaccagcaagaaacttcatcgaaagtatctccagaacttgcaggttcatgtaaatttgataagccaaaggaagatggacaaagtaatgatagaatcagcaaaatgttttctcccaaagtgttagcaccacagacaaagggatcactcaaaaaaataagtatcgtcaccaactggaatgccccccaaaatatagaagaacaagatattgtcatgaaaaagcaagtgatccgacggtgtgaacatgggcacaagaccaggacgaacactatcctttctaagtttccccttcaaagtggaaagcagaagacaccatcggaaacagatgtggacaagaaaacaacagcgcacctcagcctacagatgctaccaggaatacacatggatatgacagagattgaccctgcaaaagggggaaggaagcaggcattgctcatttcagaacaagaggaaggtgttctggaatttcttccgaagtccctattccctccctggacttttcaatttcaatcaggggatctggaggaaaaacatcaaacagacgcaaacaccaatataaatctagagcagaaaaaattagaaatggacaatgatagtactgtgaatcagaaagaagggaaattaaaaataggcacaaacagagctttacatctgcaagaagagaaaacagagatgcacaaggccaggactgccaatctggagaaggagagaggaagaatggacacaagcagtagtgcacacccgcatcttctatctctaaaggcagaggaatctcaaatgaagactcaagtcatcactcatagggagaacagccgcctaatcatgcaaaagcagaaaaaagaactagaagcatctaatgcaaaacaaagcattcaactacaaaaattatttcaaagaaatgttctggattcattttattcatatgttcctctttctcccaaacgtaaagatcagaaaggcagattaacaataagagatctgaaaagagaattgagcaccaaatatttaactatgaaaatccagaatcacccaattccacagatgcttaatatcacggggcgtggtacaccaagcaatagaaagaaattagagtatgatgttaagttaaagaacatagcttcgtggagtaaagatgtctcaggaatatttatcagaagtctttctatttccatcatgcgttcacctcacactgaccctaagacaaacctagaaagagaaaagagaatctgtcttcctaaattccaggaaaaatcaccaaacactagtgaaatgtctaagagagacactttaacaattgtaaaaggggaacagaattttacaaacacagttccacaagatccccagccctttgcagtggacaaacaacaaatgcagaaacttcctaatgtcaaatcagaagcaaacctcagaagtgaaatgaataaaaaatacttaaaggcacaaacaaaagaacggattgttccagagcatgatgtctcaaggatcattaaaaaaccagacttacgtatcatcgagcaggaagaaaagattctaaaacgcattctgacacccacagagtgtccatctatgcttgaagatccaaagttacccaagcaaagggatcagagtgaaccagtatgggacatgaccacacaaaaggttcagcagcaaaaagctttcccaggaactgtgcccataccgcctcaagttaaaagtagcgaagtcaaaatagttgcagacagtacaaatgcagaacatttacttcccatttgtgaagcaaccaaagctatctctgagtcccaggttaaaaatatgatccaagacaaagtttcttctgataaactagataacatacaagcctataagcctgacgacttgaagtcaccaccttttccagagggtccagatacaatatcaacagcaatatatcccaaaacgcagcacaaatcccttttagaacagtttactcccaaagaaaaaaataagcttactagtcatttagagtcaaaagcacttgaaatacaactgaatctgataccagagatggcaaggaaatctttacaaatgttcaacttttatccaaaagggactatttcaaaagataacagttggaggttctattctagacataaaacaatgaactttatgtctctagaagggactgataccatagaacctaactcaaaacataaacaccaaaaggattcacctcttgccagcaatatgaagacactgattgttgatgtttcaagtgacagtgaggagacaatcacaaagctacagagtattaataagctagaaaatggaacatctgcagtgacttctgctagtgagatgctattgcctcataccctccaaaaccactcagtaaaagaaaaaggcaaactcctcatgcacttttctgtgaaaacattggagatacaaatgaaagcctttcccagaattgtaagagaatcttatgcaatgaccagtgctcatgagagaaagaaacccttatctaactgtattcatcctggtttcacaggaccaaaacgacaaaacagaattttgttactttctgaggagaaatctctccatcaaatagatcttgatttacaatacaaataccttcgttttctcctggggcttcctgttggaagtacgttccctaagccaaatgtacttcccaaacatagtaagttaaacacaattgcagtgtgtaaaaacgtaaatgctggtggacaaagtggtagtctttccattgatacagaactgttagaacaacatatttctttcaaaaagcaaagtccccatgaaaactcatcactcatcagaaaattcccacagccaacccttgtgtgtgcttctgaccgtgatctgcacagcccgaggaagaaagatactcaagttctttcagagtcagaattccatgtgactccagaaaaaaacaaacaatatcatgtatggtttcaagaaagaaatacatgtgaatctgttgatttaaggacccagagaaatgctactggttcagctgtttcatgtgaaactcagatttctgaagattttgttgatattcagacagatattgagagtccagctgacttggacgagtgttcatgtcttgaagtaagtgagagtgaggaatgtgtgtttctggaagccaactcttatttaagtcaggaatcagaaaacattctatttgaattacagacaggcattcctttggaaaatgtctacaaaatcacgactgatttgaaatcattttacagtgaagattcaggttcccattgtactagagagtgcagaaaggaaaccttaattattacaccaccttcctgtaagtcccacaaaagcaggaaatatagatcatcttccaaaatgaaatctcctgactggttgtgtcatagttcatcaaatactgcggaaattcagtctaggtcatctagtgtatcattcagtgaagagaagatttcatggactaccaagagcagaacaagttactcttcagctcccttaactgaatcaaatattaaatcacatcttgcaaaaaaccaaggcaagtctcacaggcacccagaaagccaagaaagaaagaaggccagatctgatttatttaggaagaacagcagtcattgggaccacgattacagttgtacacacagcaaagggaaacgtgacagaaagaagagagtgtatgattatgagtcagaaagattggattgtttccaaagcaaacataaatcagcatcaaaacctcatcatgacgatatcaacttctattctgaaagaaaacaaaaccggccctttttttttgcctgtgtaccggcagactcactggaggttatacccaaaaccattcgctggactattccccctgaaaccttaaggaaaagaaacttcagaattcccctagtggcaaagatttcaagttcttggaatatatggagttcctccaaaaagttgttggggtcgctctcggggtcccttactaccgtttttcatagctgacattaccatagctaaactcctctgaagtggacagctggtcgctattgtgatattctgtgaaaaatacaatcatataac

SEQ ID NO: 27756 - DNA, 2317 bp, Homo sapiens
agttaggtgaagaggagaacgatgtccaggcaggggccggggaagcccgtgccaaggcactgaggggaagtgctgcaatgaacctcagaggctggatcttgctgactcatctggggtaccaagggcagacaaaggacatggagtccaggcccaggaggcgataccaggccagcagtttcactgatgctcctgtcatgacgatgactgcctccctcctccccttggtccctgactcagtgtctgcagtgaccaggcaccaggcagggagcaaggaaccaagcctttcacctgctcccaccaactcctatggtgctccctttccaaggctaggtctcctctccacccagttccttatcacgtaccatgagaagctgtcaccttggcaactgtcaccttctggtgagatttacaattgcactgctacaactgcttgtggcatggtaaagttgcaccaggacctctgctgtccatgagatcaaagttccaggccaaggcaccaggggcacgaacagtgttgcccgcatggaactcacacttaatgggagcggcagccaacagagtcttgctgtgtcacccaggccggagtgcactagcacaatctcagctcattgcaacctccatctcccaggttcaagtgattctcctgcctcagcctcccgagtagctgggattacaggcctgtgccactatgctaattttttttttttgtattattagtagagacagggtttcaccatgttagccaggccggtcttgaacttctgacctcaagtgatctgcccacctcggcctcccaaagtgctgggattacaggtgtgagccaccgctcctggctgaggccacctcttttcttggggacacttgggctccagctttctccattcatcagcttagcatgagcttgaggaacgcagaggggggctgactgagaggagcaggcactggggacaatggggacatccacggttcctagcaatggatttgaggtgggatttccaattcctcttctcccaccttggatttgaccatctgaataccaaattcctgtcacttctaggatgtcacctaagatgagactgtggtctttccactcttgggtcccaaggaggtgccacagggcctacaataaggcaaggaaggctcagtgaggtccgtgttcaccccacccccacttcaacacgaggagttctgcttttattttgcctctgtgtgtgtgtgtgtgtgtgtgtgtttctaggtattattttatttggagaaaggatttgctcctaaggacacacacacgcacacacacatgcacactcacgcacacgtactcacaggttctgcaaaacactagtgtggcagaaagtgttgaaaactagttctagacctggcatgaatttgaccaggttcagccttagtctcctctcttagaaataaggtcatctgggccaggtgcggtggctcaagcctgtaatcccagcactttgggaggccgaggtgggcggatcacgagatcaggacctcaagaccagcctgaccaacatggtgaaaccccgtctctactaaaaatacaaaaattagccaggcatggtggcacgtgcctataatcccagctagtctggagggtgaggcaggagaatcgctggaacctgggaggcagaggttgcggcgagccgagatcatgtggggaaataaggccatctggaaatatccttcccatcacaggatgatacccggcaaattcttcaaagcagtgttctccaacttgaatgtttgtgatgtgggcgattctgactgagggggtctgtagaccacatcttgataaacaatgctttttaaaaaattcctagaagagaatatttgatttctggaaggatagagaagaaactaataagagtgtttacctccgaggaggaggagaattgggaagctgagagcagaggagggaggaagacttacttttcaccgtgttcttttttgtaccttttgagttttgtacgacatactgaatctttgacccatttgcaattataaataaaggcacatttatttggccgggcgcggtggctcatgcctgtaatcccagcactttgggaggacgaggtgggtggatcacctaaggtcaggagttagtgaccagcctggccaacatggtgaaacctcgctctactaaaacacaaaaattagccagatgtggtggcaggcacctgtaatcccagctactcagaaggctgaggcaggagaatcgcttgaacctgggaggcagaggttgcagtgagctgagatcgcacgactgcactccagcctgggcaacagagtgagactctgtctc

SEQ ID NO: 27757 - DNA, 5256 bp, Homo sapiens
gagatcaccataaagcctttcccaacatcaggacagtaaagcaactactgaaaaccattcctgaatttgtgatcaatggactcaagtttagggagaggagcacctttggtctgcaacaatggtttgaatcccagtctctaattacttctttcccaaatactctggtcaccaaagggacaatatttggtgagatgcagccattttgttggttagcaggagttcagacgcaagacaatgtcatagtggtagaatacagtatcaacttcaacagcaagcccatctctggaagctcccagaccattgtgccaatcaagtggaggaggcactttcatttagagaggcttatgtgaaccttatatgagaaacttgccaacctgcctctttgattttttagccttactatttctaatacttaggtgctatcttttagagaccctgaaacagccaagacatgacacttagtacagaggaatccatagaggtgtttggggatattaacctcactcttggcatgttgaacaaggaagatattgttaacaaggaagacatttacagtcatctcacttctgttattcagaatactgacatcttggatgatgcaattgtccaacgattgatttattatgcttctaaggatatgagagacaacaatatgctcagagaaatcagaatgctagctggtgaggttttggtgtctcttgctgcacatgatttcaactctgtgatgtatgaagtacaaagtaacttcaggatcttagagctaccagatgaattcgttgtgcttgccctggctgaattggcaaccagctatgtgtcccagagtattcctttcatgatgatgaccctgctcaccatgcaaaccatgctcaggctggccgaggatgaaaggatgaaggggactttctgtattgcccttgagaaattcagcaaagccatttacaaatatgtcaaccactggagagattttccctaccccagactggatgccaaccgactgtctgacaagatcttcatgctgttccggtatataatggagaagtgggcccctttggcctcacccatgcagactttgagcatcgttaaggcccacgggcccacggtgagcttgctgctgcatcgggaagacttccgtggatacgccctgggccaggtgccctggctcctgaaccagtataaagacaaagagattgatttccatgtcactcagagcctaaaacaaatactgactgcagcagttctttatgacattggccttccaaggagcttgagaagatccatctttatcaatttactccagcagatctgcagagctccagagcctccagtaaaggaaaatgaaatgaaagcttcaagctgttttctcattctagcccattccaatcctggagagctgatggaattttttgatgaacaagtaagaagtaataatgaagccattcgagtgggaatcttgactttgttaagattggctgtcaatgctgatgagcccaggttgagggatcacatcatttcaatagaaagaacagtcaaaatcgtcatgggtgatctcagtacaaaagtaagaaattctgttcttctcctcatccaaaccatgtgtgaaaagtcctatattgaagctcgggaaggatggccattgattgattatgtcttctcccagtttgcaacgttgaacaggaatctggagaaaccagtgaaaactaactttcatgagaatgaaaaggaagaggaatctgtccgagaaacaagccttgaggtcttaaaaaccctggacccactggtcattggaatgccccaggtgctatggccaaggatcctgacttttgtggtacctgcagaatacacagaagctctggagcccctgtttagtatcatcagaattctgattatggcagaggagaagaagcagcacagtgccaaggagtcgacagcacttgtcatctctacgggagctgtgaaacttccttcaccacagcagctactggccagacttctggtaatatctatgcctgccagtttaggggagttacatggggctggtgcaatagggcttttgaagatactgcctgagataattcacccaaaattggtagacctatggaaaacacgtttacctgagcttctgcagcctctggaaggaaagaacatcagtaccgttctatgggaaaccatgctgcttcagttgctcaaagaatccttatggaagatcagtgatgtggcctggaccattcagctgactcaggatttcaaacagcaaatgggcagttacagcaataactccactgagaagaaattcctttggaacgccttgggaacaaccttagcatgctgccaagattcagactttgtaaactcacagattaaggagtttctgactgctcccaaccaactgggggatcaaagacagggaataacatctattttaggatactgtgccgagaaccatttggatattgttttaaaagttcttaaaacattccaaaatcaggaaaagtttttcatgaatcgatgtaagagccttttttctgggaaaaagagcctgaccaagacagatgtcatggtcatctatggagcagtggccctccatgctcccaagaagcaacttctctccagacttaatcaagatatcatatcccaagtcctgtctcttcatggccagtgctctcaggttctgggcatgtctgtgatgaacaaggacatggatctgcaaatgagtttcacaagaagcatcactgagattggcattgctgtccaagatgctgaggatcaggggttccagttttcctacaaggagatgctgattggttacatgctggacttcattagagacgagcccctggattccttagctagccctattcggtggaaagccttaatcgccattaggtatctcagtaaactgaaacctcagctctcactacaagaccaccttaacattcttgaggagaatattcggaggctgctgccccttccacctctggaaaatctgaaaagtgaaggccagacagacaaggacaaggagcacattcaatttctctatgaacgatccatggacgccctaggaaaacttctgaagaccatgatgtgggataatgtgaatgcagaggactgtcaagaaatgtttaatcttctccaaatgtggcttgtttcacaaaaagagtgggaaagagaaagagccttccagatcactgcgaaagtgctgacaaatgatattgaggcaccagagaactttaaaattggttcactgcttggacttctggctcctcactcctgtgataccctgcccaccatccgtcaggcggctgctagctcaactattggtctgttctatataaaaggcattcacttggaagtggaaagactgcagggtttgcaggaagggctggaaagtgatgacgtgcaggttcagatcaagatttcttctaaaatagctaagattgtcagtaagttcatcccaaatgaagaaattctgatgttcctagaggaaatgctggacggtctggagagcctcaaccccacttgtacaaaggcctgtggcatatggatgatcactgtcctgaagcagcagggagctgctctggaagatcagctattggagatcttaggcacaatctaccatcacatgccagtcctcagacaaaaagaagaaagttttcagttcattctagaagccatctcccagatagccagctttcacatggatacagttgttgtcaaccttttacagaagcctctgccttttgacagggacacaaagacattgtggaaggcgctggctgaaaagccagcctccagtgggaaactcttgcaagccttaatagacaaactggagactgagttagaagatgacatcgccagggttgaggcaatttcagtggcctgtgctatgtatgaagtgatctcaatgggcacctctgtcaccggcttgtatccagagctgttcactctcctcctgaagctggttagctgcacactgggccagaagatgcccacttgtccctggagccataggcggcatgtgatgcagcagggagaacagcagcagatcccagacccctgcaggctttcaactgctactttaaaatgtttgcaagcccaagccatgagagaaggccttgcaaaggaatctgatgagggggacaacttatggactctactcagcagtcctagtacccaccacataggcgtatgttcactggccaggagcatggcagtgtggcaacacggagtcatactggacatcatggaacagctgctctcatctcttacctcctcctcggagaactaccggataaccggcgcagctttcttctctgagctcatgaaggaaccaatcctttggaagcatgggaatctgcgaaatgtgctgatcttgatggatcaaagtgcctgggactccaacgccactctgaggcagatggccatccgagggctcggcaacacagcatccggggctcctcacaaggtgaagaaacataagcagttaatgctagaatctatcatcagaggcctgtatcacctagctcgcactgaagtcgtctgtgaaagcttgaaggctctaaaaaaaatcctggagctgctgacagaccgagacgtgagcttctacttcaaggaaatagtgctgcaaacaaggaccttctttgaagatgagcaggatgatgtgagattgactgccatcttcttatttgaggacctggcacccctaacaggaagaaggtggaagattttttttgctgaagaaataaaaaagagcctgatttcattccttctgcacctttgggatcccaaccccaagattggagttgcttgccgtgatgtcttgatggtctgcattccctttttgggcctccaggagctctatggggtattagaccgtctccttgatcaggatctaccaagggccagggatttctataggcaattctgtgtgaaactggccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacgactccaagcacttcgtcaagatccatgtattagtgtccagagagcagctgaggctgctttgcagaccctcctgagaaggtgtaaagagacaagcattcctctgtaagccatcaagaaataaactgctggcttttcccaaaaaaaaaaaaaaaa

SEQ ID NO: 27758 - DNA, 1713 bp, Homo sapiens
tcttcccaggaggctcctcgctgcctggtgccgtagaggcccatggaggaaaaggaagataagcatcaggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcttgagagcagagaaaagacctcaggcgccactcaaacaactgtaggagatgctcttttcactacgcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtggtctccaataagtggagtgagacattatttctatgtcacattctttatgaacacaactttgttttgcacaacacatgatcgtaattaacaaatataatacttttagaagagaggccctgttagacatgagtggacagctttggaatcaaacaaactagagttggaatgttgccttcacttcattccttgagctgtgtgaccttgggtaagtaacttaacctctctagacttcagttttctcaactgtaaaattaggaaaatagcaacttcgtaagattattgaggatgtgattatgcacattgatcagtaagtggtcaatgtaatcatatcatcactgctactataattcaattttcaatttaaggataatgttctcttatatatttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgccaaaatgtatctattataagatatgttatattgcatacaagtggaagtaggtggagtattcctctgttataaagagtatttacaaatttccattgggaaatatcagctgctcactattatctgcagtattgataagactacagctatatctttatccatttattctccattaaagaaattgtgataaactgc

SEQ ID NO: 27759 - DNA, 1951 bp, Homo sapiens
aagttaaggcctttgtccgttgaggtcaggactaggtggtctcagccaatggggacagagcggtcacggggaccgggtttgcgcggctccgaggcctaaccaggcagccgagcctgcctgcgtcccgaggccgccttcccgggacctctgcaccctcaggtcctccgttgggtggtgttcgggcggccgccaggcttcccggcccgccactcccgctgccacccaaaggcgctgcgtgccggcggcttggtggagtttcgtcgaggcccggcaggcttgggccaggagatccagcggccgggcggggtcccggctgagagaggccgatgccgccgtcagtcaccgagatggggtggggacgcttcaaggcctgggtctggccagggggcagtcacagcagggccctagggtaatcactttgatcaacatgacgaaggacacttggaaactgaacaagcatcacttgacaagcctacagaatccataagatggatcattgcttaatttcgggtcttagccagttagatttaccttcagctttaacaaaaaattggccgtcaaaacctgagtcctgtcctcttgccctcctccccggacagcatgaacttcaccacttgctccaccctctccaccaactaccagtccctgggcactgtccaggcacccagctatgtgcccagctggtcagcagtgtggccagtgtctatgcaggcatcaggggctctggttcccggatctccatgtcctgcttcaccagcttccagggcagcatggggtccaggggcctgcccgcagtgatggccgggggtctggcaggaatgggagtcatccagaatgagaaggaaaccatgcaaagcctcaacgaccacctggcctcctacctggacagagttaggagcctggataccaagaactggaagctggagagccaggagcacctggagaagaagggaccccaggtcagagactggagccatgacttcaagaccatcgagaacctgagggctcagatctttgcaaatactgtggacagtgcccacattgttctgcagatcgacaatgcctgtcttgctggtgatgactttagggtcaagtatgagacagagctggccatgtgccagtctgtggagagtgacatccatgggctccacaaggtcattgatgacaccaatgtcacttggctgcagctggaagcagagatcaaggctctcaaggagaagctgctcttcatgaagaagaaccatgaagaggaagtaaagggcctataagcccagattgccagctctgggttgactgtggaggtagatgcccccaaatctcatgaccttgccaaaatcttggcagacattgggcccaatatgacgagctggctccgaagaacttagaggagctgggcaagtactggtctccgcagattgaggagagcaccgcagttgtcaccacgcagtctgccgaggttggagctgctgagatgacgctcacggagctgagacatacagtccagtccttggagatcgacctggactccatgagcaatctgaaggccagcttggagaacagcctgagggaggtggaggcctgttacaccctgcggacggagcagctcaacaggatcctgctgcacttggagtcagagctggcacagacccgggcagagggacagcactaggcccaggagtatgaggccctgctgaacatcaaggtcaagctggaggctgagatcgccacctaccaccgcctgctggaagacagtgaggacttcaatctttcaatcttggtgatgccctggacagcagcaactccatgcaaaccatccaaaagactaccacctgccggatattggatggcaaagtggtgtctgagaccagtgatgccaaagttctgataccttaagccagcagaagcaggggaccctttggggagcaggaggccaataaaaagttcagaggtt

SEQ ID NO: 27760 - DNA, 2553 bp, Homo sapiens
ttttttcctaggccagcgggcggttgtctgtggctccgcgactgggcgccccgtcacggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatgctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaag

SEQ ID NO: 27761 - DNA, 1657 bp, Homo sapiens
gctaggccgaaacgcctgtatttaaagggatagtaactcggactcgttctgcaatatccccacaagggcctgactgagcgagcgagcatggacggccgcggggctttctggacagtggccattcccagagccaggcaggaaggcctcgggaggctggggctcccgttcccggtgaagcggacgccgccagcgccccagaacccaggaggaagcacacaggccccacagagagtggttggcaagagtcactcggggattaggatgccggccaaatcgcggaatttgaggctggaatccaagctcaacaggactgctgtgtgtgaagcactcaagagggcccctacaaccaacctgccaggagtcggctcctgaaaacagggtcggaaaaggggtatggcactcttcctcatgcttacgagatggctgctggaattccaggaatcacatgcaaattctagtcaggagcaaagaggaagagacacagtgaaaaggggtatacagcggcagaaggaagctcctcaaatgaactctgctagaactctagccagtagcttctccttctatcacagtggccagaactgtgacaagtgaccatccttaggggaaaaaagatgctgagaaatgtgaattttgttgccaccttacattttcaaaggagttccattcgtaagtacagaacgctcagagaagaggcagcagatctaggatatggagcagcagctcttaagggcacagtgggaaggtttcaagactgaggaggatcttggatttgggtaggggaaggcagttcacagtattgtggaggaaatgctgtgaaagagaaagtggaaggcatggaagcttaaacttttaatatgactggtgaatacaaggatgaagggcaaagggaattcagactcatggtggtcagattaagaccttcagcggctctgtctcccagccccacatacccacttccatgttctgctctttactgaagctgaaagtctgcaaccttcattctctgactcccttacattttcttaggcttcttgctagcttctgccaaaaagaggccctggcaggagattagatggcaggaggcagaggtaaggattccatgttaacaggtgctggaagttgctggtgtggcaatgagaactgggccccggtcaaggcagcactactttggtagatccagaatcaaccatgataaccgtgacagtgtcttcaacagtgcagcagtagacacaggcccctggtgctggaatccaatacagggacaggagcagcacggagtcacggaacaccgtcttgccttcatgtcactttaccatttcttctttctccctcttactctaccagctacctgtggagatgttgaaccttttatctgtcgctgtctgcttaggaacagaagaaaaggcagctcattgcttgactcagctttcagcttgatttttttcctttggcagagtgaattggggtcccaggtgttcattttccttttgtagtacctttcctcagcatgcaattaatacaaaaagaacaataaaccttaacaaagtttggcttgtattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27762 - DNA, 2646 bp, Homo sapiens
actctctgcccttgcagagctcactggaggaataaacctttgtagaggaaggtttgatgggctttcctggaagaagtactcataggaaaacccaaaagctcaacagatgctgtctccttggttaacattaggagctatgatctccatcttcccatggcattagaggtttagatactgaggatcagagaggcaagttcagcatcagaaggcaggaagaggcagaaatctggacaccgattcctaactctaaagctgcgtcatctctagtgcatctcatcagctcttcccaatggcaccaatcaactttagcatactggccagccggaatagatgtccttgggcattcttaagatctgagactgtgatggttaattttagggtatcagcttgactgggttgaggaatgcctcagtggctggtggcgtccatcattcctgggtgtgtctgtgagagtgtttccagaggagactcacatgtgagccagcgggctgagaaggagacccgttctcagtgtgagtgtgcactgtccaatcagctcaaggccaggctggggacaaacaggcagaagaaggaggattctctctcccacctttcaggagcaggatgccttttctccttggacatcagactacagggtctttggcttttggattctaggacttgtaccaatggcctcccggggccctcaggccttcagcctccaacgaaggtctgtgctgttggcctccctgattctgaggcttctggacttggactgaggcatgctacgggcttctctgattctccagcttgtggatggcctatcatgggacttctccacctctgtaatcacaagggccaatgccccctaatacctttcttttcatatatcctactggttctgtctgcctggggaaccttgactaatacagatatggagcatttgaaatgagaggatttctgatcctgttcttcaagaagcagtaggtcagagcatacctctttaaaataacttctggatagtttcacagttagaaagaatcagcttcaggtgatcttgaagatcccacttggattccactctccagctctcaggaagctctggcttccttacttcttctgggattttcctttcatgctggggagagatgctccctcaccactacccagcccatgggacacaccgagtctggtggaggatgctgtgacctgtggtgcttgtgattgcgtcttactgtgtcgcccagactgaagtgcagtggtacagtctcagctcactgcaacctcggcttcccaggctcaagcaatcctcctgcctcagtatcccaagtagctgggaaaacaggtaaaagggaagcaaaggaagaaagaagaaaagaagacaacccatgtaggatgttaaccaggtcactggttttattgtcacatgcttttaaaagaacatgcatgagtgagctgtctcactttccaatccaagaatgtttgattccactgtgatgaaaaattctgtgacctggcaggaaaacactacaagaagggcagaagcggaaaattctttctattttccaatatggctttctttgattcaagaaaggcctcctctcctccacatctctgtcctgctcatgaccccagaagatctcaggttgactgcatttgttctatgccttcctcaagcttcacctcttctgtgagcctcctgggtgggctccttctggctaaatcttcctcctcactgttgcctttttatcttatgcaagcacctgccttatctaaaggtacataccttttcatagaacacttgcctgtttacctagctatttccccatgactatgggctttttgagaggtgctgtgttatttatttatttatttatttatcattttgttttgagacggaatcttgctcttgttgctcaggttggagtgcaatggcgcgatcttggctcactgcaacctccgcctcccgggttcaagcgattctcctgcctcagcctcctgagtagctgggattacaggcacccaccaccatgcccagctacttttttttgtatttttagtagagaaagggtttcactatgttggccaggctggtctcgaactcctgacctcaggtgatccacccaccttggcctcccaaagtgttgggatcacaggcgtgagccaccttgcctggccactgtgttatttttttttacttctataccttcagcaccccaaacagtgcccaatacaaagttccacactaaatatttattgatggaataatgaatagggttgggggcactggcagggagggtgcccactgggctgaaattctggggcctgaatgcatcactcccttcgcctctggatgagaaaaaagagggacagtacccatgaggcccctagggaagccttctgcagaccaaaagacctctttgaacagagggcagaggaaacaggtctagagaaagtgaatgtgaagattcaggctttagaatgagccttgcagacctgctggcagtgacaagaattacctgtgtacagcaccttgtggttcccatgaccccatttagatctcatcatgaccctgttgggtggatgttattttctgctttacaggggagagaggccaaactcgtgatatgatctgtctgatatcacttacttaaacagttaagtggt

SEQ ID NO: 27763 - DNA, 4849 bp, Homo sapiens
cttaggaagccatgctattcaaaccatggagaatatcctctgttttctaaacagctatactgagacagggcttagccctgactcaccttgtttggatggatattgaccacaactgcatctacttgagtgggttggggttgtttatgctgtactttttctatgtggtattgatgctgtgtttgtcaacccttgggaaaaataatgatatccaaaagcatcagggcagagccaggaggagaaagaaaggtgggacatataaagaccggaaaagtttccagagagaagccgaagaggaaaggaagttgctttctattctgaaaagctttggacctcctgcttcctgcagtcccctgggtcagcatcatgataccacccgctttcatcgactgttatgcccagaccccgtctgtcaggtgtgtaacagagcaactgctgatatccagcgactgctgtcttgggagtccctgaaagatgctgttccctttgtgtcccctttggcttcttcagcttctgcgactgagtcatcattcactctggcttccaccccctcagcaaccactccagaagacctaatattgtccccgcagcctaagccttctctactgccccacttaattctctcccctgacctgatcaccaccttagctgacttattttcaccctcaccactgagggaccctctgccaccacagcctgtttctcccttggattccaagttccccatagaccattccctaccccaacagcttccctctccccttttcccaccgcatcacattcagagagcggagcccagtctccaacctgaggccagtttgtctctgaacactgtctttttatttgactccaccctatcccaagatatgaaccccttatcaaatatttcccaggccatgaatgccactgattcatgtgcttggcatcacgaaccaccaaacccatctgctttaccactggaggactgccctgtaactcagtctaaagcaagtcccacagtattgaagccttttccggagatgttatctctaggtagttctggtggatcatccacatgtgccccaacaatcagaggcattgacattcatgccctgcatcttcagaattctcctggtggcagcctcatgacaaggacttttttccttccactattgcaccatatgatttcatgcaagagcttcttacccttcattcttctgagatcactataggagggcactctgtggtcaacctcacagagcctattaacctctcatttatcagtcatgacattctggcactcctggagagacaagtcaaaaaaaggagtgatttcctgatgtggaaagaaaatgaaaataaagcagaatcttttccaaaacaacgtaggccaaactatcaactaaattcttcacagaaaatgttagcctcaattgcagataagcaagacttggcaacctcccttcctttttggggccagtaaagacagactagaacaactgcacatccatcagcagcccccatattctaagtgttttgaggaccatttggagcaaaaatatgtccagctcttctggggtctcccatctttgcacagtgagtctctgcatcctactattcttgtccaacgtggccattcctccatgtttgtattcttcaatggcattacaaatacatctatatcccatgaatccccagtacttccccctccccagactctgtccttgcctagtacccaacctctaccctcgcctcaaaccctgcccagaggtcagtccccacatctcactcaggtccagtcccaggctcaatatcaatctccaatcccagccctactacctagtcctctatttctgtttaggtgtgtggattgtgttttcatagaccccaggatgaggcacggtctcttatgccatctgaaattaatcatctggagtagaacgtgttgcagaaagtgcaggaaagtgtgtggggtttaccctctgtggttcaaaaatcccaggaagacttttgtcctccaggtaccaatgctgtattggtcagaaagtctttcaaggtccatgttcccatctccatcattcctggagattttccactcagctctgaggtaaggaagaaactagagcaacacattcgaaagaggctcatccagcgcagatggggcctgccccgcagaatccatgagtctctgtcattgctacgtcctcagagcaaaatttcagagctatctgtgtcagacagcattcatggaccgttaaatatctctttggttgagggtcagaggtgcaatgttctaaagaagtccgcatcaagcttccctagaagcttccacgagaggagctcaaatatgctttccatggagaatgtggggaattatcagggatacagccaggagactgccccaaaagatcacctattgcatgatccagagacatcttcagacgaggatctgaggtctaactctgagagagacctagaaactcatatgatgcatctgtcagggaatgactcaggggtgagactaggtcagaaacaacttgaaaatgccctgacagtacgtttgagcaagaaatttgagaaaatcaatgagggtcgaatgcctgggactgtgcatagttcatggcactcagtcaagcagacaatgtctcttcctgagaaatcccaaagccaaattaaacatcaaaatctggtagcattggtgagtgaggaccactgcgttgatacttcccaggagatttccttccttagttccaacaaacaaaagatgttggaagcccatattaaaactttccgtatgaggatgctgtggggccttccctgcaaggtccttgaatccatagaaatcttcaaatcggaagaggatatttccaattccttttcccatttctaccttccctcctcagccagctttatttctcagggagattccaaagatggggtctctaagtcttgtagacgaagcacttttcaaggagaaaagttgggaacaacaagctcagtccctgtccttaatcatcctcagcctgtctcctcacctattggcaaagaagggcaggggaccctgagaagacaattttctgatattgaccatgaccttatagagacagatgccaaagatggtgcctccacgccccttagaagaggcactacatattttcaaggagaaaaattagaaacaacaagctcattctccatcttgggtcatcctcacctcgtcacctcacctgttgatcaagaaaagcaggggaccctcagaagagaattcgctgatactgacgaggatcttacagaaagtgtctggacaactgaggatggcagacagacttttctgccccccacatacagcatcatagacgaagtcagtcagaaacagactatacttgccagtagatgcagcgcagagctgcccatactgcaagctggagttggccgtgattcaagggataagagagagagtgccagtaataatgttaacaggcttcagggcagtagaaagacctttcctgtcaccaatgggtcgaaggagatgttcaaggaagaggagatctgtactcttcaatcacaaactaggaacaacttgacaaccagcaagtcaggaagctgcttagtgacaaacgtgaaaagaagcacttctcatgaaactgaaattttcccaccaagaatatcagttcctcaaactcctaaatcatcatatcttaaaaatcagatgttgagccagttaaagttggtccagaggaagcatagccaacctcagagccatttcactggcatgtctcttgccttagataacttgagttccaaggacttactgactcatgcccagggcatctcgaatcaggacttgggaacttcccaggtgctgcatgtccacttggaggtcagaggaatccgtgtggcacagcagcaggagcccagggtccctacgcatgtcttacagaaatgccaagttaagaatttttcaccagctacaaagagagtgagccctctaagacctaatggaggagagcttggtggaggggatgcagggttggggacatcccaactcagaagaaagagccatgctattcataacaagacatcaagggagtcgcttgggagcaaatcttccccaaccttgaaaacacagcctcctcctgaaaaccttttcggaacattgatgaagacctttttgcagcagtctaataaacccatcataacatatggaaaacaagaaagttcctaggaaaagggtagctccttgtcatcatctgtgcagaatagaggtcgagttaaaagtagagctgtctttactgggactattgaagctcagaaaattaggaaagacactggggagttcatagaagagaagctggggcatagacattgaatagatatcacctgtccccaggagcccctttcctccccagtgcagcttgggaaatctcagaatgtgccagaactgcaggtcagagcagagcctgtccagggctatccctgcaactacatggctccctcctgcaaagtgacatgtaccaaatcttgcagccaacaagctatctttgtcggccagaattatcctgcaatgattagacagatcatagacaaggacagatagccccaggaagttggacatttaaggggaagatattgtgtcaaaggcatccccaatccatgccccacaggaagcctgtgccacagccaaaccccacttgcagtgtgaagtcaacctggtgcctccggtcatcctgaccagtgctaaaaacactgtgttcagtgatgtgcctttactaactggacagaaaatacttccaaagcatttgcagggaggaaaatttccccccaaaaaataattaactccttgttgagaatcttgactctccccaataaacgttct

SEQ ID NO: 27764 - DNA, 5071 bp, Homo sapiens
cttaggaagccatgctattcaaaccatggagaatatcctctgttttctaaacagctatactgagacagggcttagccctgactcaccttgtttggatggatattgaccacaactgcatctacttgagtgggttggggttgtttatgctgtactttttctatgtggtattgatgctgtgtttgtcaacccttgggaaaaataatgatatccaaaagcatcagggcagagccaggaggagaaagaaaggtgggacatataaaggtaatgtcgacctgctctatctgagcttcagggtgacccttcctgtctctttcatgaggactcagtcccatgacttcttagaatgtcagttactagatacagtctcagaaaacagagccctcagaagacaggctcatgggaaagcgataagacctgagacaccgctcagaggccctgctctgcccatccatgggcaagacttagtgatggacctgagcaatgagtgttgcccaataggcagccaagttagatatcgaggaaggactactggttgacttggagtcagagcttctgtctcacaactttgcataagtaatttgacttccttgatgctcagattcctcctggaggtaaccactgatgtctatgtttcacgtggtggttttgagcatcacatggggtaatgtatgtgaaaggactttactaatgatgccacatacacatgtgaacttgtgaatattatcaatgactatttgcccttttctactgattcttgggactatcagagtttaatatcccaagggtcttccacagagtgacttctgtatgagccatgtgcctctaccttcattgcatataacatactgttctgctttcccagaccggaaaagtttccagagagaagccgaagaggaaaggaagttgctttctattctgaaaagctttggacctcctgcttcctgcagtcccctgggtcagcatcatgataccacccgctttcatcgactgttatgcccagaccccgtctgtcaggtgtgtaacagagcaactgctgatatccagcgactgctgtcttgggagtccctgaaagatgctgttccctttgtgtcccctttggcttcttcagcttctgcgactgagtcatcattcactctggcttccaccccctcagcaaccactccagaagacctaatattgtccccgcagcctaagccttctctactgccccacttaattctctcccctgacctgatcaccaccttagctgacttattttcaccctctccccttttcccaccgcatcacattcagagagcggagcccagtctccaacctgaggccagtttgtctctgaacactgtctttttatttgactccaccctatcccaagatatgaaccccttatcaaatatttcccaggccatgaatgccactgattcatgtgcttggcatcacgaaccaccaaacccatctgctttaccactggaggactgccctgtaactcagtctaaagcaagtcccacagtattgaagccttttccggagatgttatctctaggtagttctggtggatcatccacatgtgccccaacaatcagaggcattgacattcatgccctgcatcttcagaattctcctggtggcagcctcatgacaaggacttttttccttccactattgcaccatatgatttcatgcaagagcttcttacccttcattcttctgagatcactataggagggcactctgtggtcaacctcacagagcctattaacctctcatttatcagtcatgacattctggcactcctggagagacaagtcaaaaaaaggagtgatttcctgatgtggaaagaaaatgaaaataaagcagaatcttttccaaaacaacgtaggccaaactatcaactaaattcttcacagaaaatgttagcctcaattgcagataagcaagacttggcaacctcccttcctttttggggccagtaaagacagactagaacaactgcacatccatcagcagcccccatattctaagtgttttgaggaccatttggagcaaaaatatgtccagctcttctggggtctcccatctttgcacaaccccaggatgaggcacggtctcttatgccatctgaaattaatcatctggagtagaacgtgttgcagaaagtgcaggaaagtgtgtggggtttaccctctgtggttcaaaaatcccaggaagacttttgtcctccaggtaccaatgctgtattggtcagaaagtctttcaaggtccatgttcccatctccatcattcctggagattttccactcagctctgaggtaaggaagaaactagagcaacacattcgaaagaggctcatccagcgcagatggggcctgccccgcagaatccatgagtctctgtcattgctacgtcctcagagcaaaatttcagagctatctgtgtcagacagcattcatggaccgttaaatatctctttggttgagggtcagaggtgcaatgttctaaagaagtccgcatcaagcttccctagaagcttccacgagaggagctcaaatatgctttccatggagaatgtggggaattatcagggatacagccaggagactgccccaaaagatcacctattgcatgatccagagacatcttcagacgaggatctgaggtctaactctgagagagacctagaaactcatatgatgcatctgtcagggaatgactcaggggtgagactaggtcagaaacaacttgaaaatgccctgacagtacgtttgagcaagaaatttgagaaaatcaatgagggtcgaatgcctgggactgtgcatagttcatggcactcagtcaagcagacaatgtctcttcctgagaaatcccaaagccaaattaaacatcaaaatctggtagcattggtgagtgaggaccactgcgttgatacttcccaggagatttccttccttagttccaacaaacaaaagatgttggaagcccatattaaaactttccgtatgaggatgctgtggggccttccctgcaaggtccttgaatccatagaaatcttcaaatcggaagaggatatttccaattccttttcccatttctaccttccctcctcagccagctttatttctcagggagattccaaagatggggtctctaagtcttgtagacgaagcacttttcaaggagaaaagttgggaacaacaagctcagtccctgtccttaatcatcctcagcctgtctcctcacctattggcaaagaagggcaggggaccctgagaagacaattttctgatattgaccatgaccttatagagacagatgccaaagatggtgcctccacgccccttagaagaggcactacatattttcaaggagaaaaattagaaacaacaagctcattctccatcttgggtcatcctcacctcgtcacctcacctgttgatcaagaaaagcaggggaccctcagaagagaattcgctgatactgacgaggatcttacagaaagtgtctggacaactgaggatggcagacagacttttctgccccccacatacagcatcatagacgaagtcatcagaaacagactgtacttgccagtagatgcagtgcagagctgcccatactgcaagctggagttggccgtgattcaagggataagagagagagtgccagtaataatgttaacaggcttcagggcagtagaaagacctttcctgtcaccaatgggtcgaaggagatgttcaaggaagaggagatctgtactcttcaatcacaaactaggaacaacttgacaaccagcaagtcaggaagctgcttagtgacaaacgtgaaaagaagcacttctcatgaaactgaaattttcccaccaagaatatcagttcctcaaactcctaaatcatcatatcttaaaaatcagatgttgagccagttaaagttggtccagaggaagcatagccaacctcagagccatttcactggcatgtctcttgccttagataacttgagttccaaggacttactgactcatgcccagggcatctcgaatcaggacttgggaacttcccaggtgctgcatgtccacttggaggtcagaggaatccgtgtggcacagcagcaggagcccagggtccctacgcatgtcttacagaaatgccaagttaagaatttttcaccagctacaaagagagtgagccctctaagacctaatggaggagagcttggtggaggggatgcagggttggggacatcccaactcagaagaaagagccatgctattcataacaagacatcaagggagtcgcttgggagcaaatcttccccaaccttgaaaacacagcctcctcctgaaaaccttttcggaacattgatgaagacctttttgcagcagtctaataaacccatcataacatatggaaaacaagaaagttcctaggaaaagggtagctccttgtcatcatctgtgcagaatagaggtcgagttaaaagtagagctgtctttactgggactattgaagctcagaaaattaggaaagacactggggagttcatagaagagaagctggggcatagacattgaatagatatcacctgtccccaggagcccctttcctccccagtgcagcttgggaaatctcagaatgtgccagaactgcaggtcagagcagagcctgtccagggctatccctgcaactacatggctccctcctgcaaagtgacatgtaccaaatcttgcagccaacaagctatctttgtcggccagaattatcctgcaatgattagacagatcatagacaaggacagatagccccaggaagttggacatttaaggggaagatattgtgtcaaaggcatccccaatccatgccccacaggaagcctgtgccacagccaaaccccacttgcagtgtgaagtcaacctggtgcctccggtcatcctgaccagtgctaaaaacactgtgttcagtgatgtgcctttactaactggacagaaaatacttccaaagcatttgcagggaggaaaatttccccccaaaaaataattaactccttgttgagaatcttgactctccccaataaacgttct

SEQ ID NO: 27765 - DNA, 453 bp, Homo sapiens
atgtctcttgccttagataacttgagttccaaggacttactgactcatgcccagggcatctcgaatcaggacttgggaacttcccaggtgctgcatgtccacttggaggtcagaggaatccgtgtggcacagcagcaggagcccagggtccctacgcatgtcttacagaaatgccaagttaagaatttttcaccagctacaaagagagtgagccctctaagacctaatggaggagagcttggtggaggggatgcagggttggggacatcccaactcagaagaaagagccatgctattcataacaagacatcaagggagtcgcttgggagcaaatcttccccaaccttgaaaacacagcctcctcctgaaaaccttttcggaacattgatgaagacctttttgcagcagtctaataaacccatcataacatatggaaaacaagaaagttcctag

SEQ ID NO: 27766 - DNA, 1527 bp, Homo sapiens
ggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgaaaaaaaaaaaaaaa

SEQ ID NO: 27767 - DNA, 1486 bp, Homo sapiens
aaaaacctttcagggctgctccgagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatccccattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgc

SEQ ID NO: 27768 - DNA, 1769 bp, Homo sapiens
gatggacgtcagctctgagcacactaaggaccccggcggggaaggcggagacggggaaagcctggccgcgcggccgtccaagatcaaggccagctctggccctccgacctctcccgaacccggggagctggagtcggagccggaggaggaggaggaggagcaagcggcttcgcagggaggcaccgccgcggacgagcaggccgaggccccgaaagggctaacggcagccgaggctgcgggcgaggaggggcctggagagccggggaggccggccgagccccagcccgagcccgaagagccggccgaggtcggggctgaggagcccgcccagccggagcccggagccgggcccgaggaactagaggcggaggcgggggcggaggaactggagcaggcggcagaggggaaggaagtcaggttccaggcctctctgccgctgaccaggatcgatgaggaagaggctgctgcagccccggaggccgagacagagcgggtggagggggaggaagaggacaaggaggagacgcagagagacggcgcggagagcaaggagagggatggggaaggacgcccggccaaaagccaggaagaggggaagcgcctctatggaagggacgagtttgaggacctcgagtggtccgaggaggtccagaagctgcaggagcagcagctgcgcagcgacctcctggaccagtaccgttccctgctggtggagcggaaccgctcccagcgctacaacctatacctgcagcacaagatcttcgaggcgctgcgcagaaagaagggcctggaggccgctgaggtggctgaccggggcgcagaggccgaggcccccgagaaagagcaagcgtacctgcgccatctgggcatgctggaggagctgaagaagcagcaggcagacgacctgcagtggtaccaccaggagctgggccagttgaagcggcagtgccaggagaagctcaccagggtggagaaggagtggcgacgcttccaggcactcaagaagcaggtggtgatgcaggccatgggcagctgtcggatgaggggcgggcgccaggctgctctgcgagaggtggagcagatccaggcgttggaggataaaaaggagaaggagatgagcgccgtgcggctggagaacattcagctgaagcagagcctggtgcattttgaaaccaggatgaggacccaggaggacctgacccagggtctgcttcttattgactttgaacagctgaagattgagaaccaaaccttcaatgagaaaattgaggaacgaaatgaggaacttttaaaacttcgcagcaaggtgaccaacagtgtgcaagtaataacccacgtgaaggaaaagctgcacttcatggacatggagaacgcgtgcaaaaagacacagctggcagaaatcgaggcccaggccgccctaggaagagacatcctgaccaagacgaagcaagcccgagaggggctgcggacggacaacatcagactgaatcagaagtgcggccttctaggcaaggactcacttcttcgggacttggaagaaaaggtggacaagaccgaactgcttcaccggcgcctggaatccctgaagcgccaccacgctagcctcactttgtcctgcagaggcgtgaggcagaagatcagggaggccaaagcctttctcccttcttgaccagatcgatgagaagagtctgcaaaacacttcatcctcaggacgtgctgtcctgctttattttaccttcgttgctattaaaaaggcctgtgtcatttgg

SEQ ID NO: 27769 - DNA, 9142 bp, Homo sapiens
ccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggcgtgtgaccccctgccgcacgaggaggagccctctgaagtgccacagctgcgccagccctacgctcctccccggcccggcgcccgccccacacactgggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcagagggt

SEQ ID NO: 27770 - DNA, 1030 bp, Homo sapiens
ggaggcttctgggccacggactgccggaccgttgggctgtgaggcagcgtctcagcgaggcggcacccggagccatgtcttcacataggaggaaagcgaaggggaggaataggagaagtcaccgtgccatgcgtgtggctcacttagagctggcaacttatgagttggcggcaactgagtcgaatcccgagagcagccatcctggatacgaggccgccatggctgacaggcctcagccaggatggcgggaatctctaaagatgcgggtcagcaaaccctttgggatgctcatgctctccatttggatcctgctgttcgtgtgctactacctgtcctactacctgtgctccgggtcctcatattttgtgcttgcaaatggacatatcctgcccaacagtgaaaatgctcatggccaatctctggaagaagattccgcattggaagctttgctgaattttttctttccaacaacttgcaatctgagggaaaatcaggtggcaaagccttgtaatgagctgcaagatcttagtgagagtgaatgtttgagacacaaatgctgtttttcatcatcggggaccacgagcttcaaatgttttgctccatttagagatgtgcctaaacagatgatgcaaatgtttgggcttggtgcgatcagccttatcctggtatgtctgcccatttattgccgctctcttttctggaggagcgaaccggccgatgatttacaaaggcaggacaacagagttgtaacgggtttgaagaaacaaagaaggaagcgaaagaggaagtctgaaatgttacagaaagcagcaagaggacgtgaggaacatggtgacgagtagcaagagaccaaagcattattttcccctcaagacaacagaaaccattcagagcagaggggactgtctcagccatgcaaacctcatggagcattttggaaagttaaaaattgattcttatttttgtcatgtttactttcaaacatgaaataaaattgagttctgttttcatgcaccaaaaaaaaaaaaaa

SEQ ID NO: 27771 - DNA, 2222 bp, Homo sapiens
ggctcgagtgcctggcgggctccggcttccgcgtccgcccctgctccggcttcgcccgcagctccgcgcccgcgggcaaccaagcccccagcgaagcccgcacagctccgggtgccaggacggggggccatgccgtgccggagggaggaggaagaggaagccggcgaggaggcggagggggaggaagaggaggacgacagcttcctcctgctgcagcagtcggtgacgctgggcagctcgggcgaggtggaccggctggtggcccagatcggcgagacgctgcagctggacgcggcgcaggacagcccggcctcgccgtgcgcgcccccgggggtgccgctgcgggccccggggcccctggctgcggcggtgccggcggacaaggcccggcccccggcggtgccgctgctgctgccgcccgcttcggctgagacggtgggcccggcgccctctggggccctgcgctgcgccctaggggaccgcggccgcgtgcgcggacgcgctgcgccctactgcgtggcggaggtcgccgcaggccccagcgcgctgccggggccgtgccggcgaggatggctcagggacgcggtcacctcccgccgcttgcagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagaactatggcagctacttgcatcgacttgtacctcacttagcccttgggggcgtcgtgagcttggattgtttaaggagggctcaggggtaggaatcgcgatggctttataacaatacttgaaaactaacgacacgcatacattttcttattttctggtggaggagcttagtaagtggtgctacaattgctgtgcaaagaaattccagaggggagaagaatgtaaaagtttggtggtgggtggcttggcattgcccctttttcccaccgattcggtggctggtgaaggtgggagatgtgaactccaattaagggactggagagaggtgaagaattttgcaggtgggagatttggatttgaatgtggacttgtaaatgacttgaccttgccatctgtgttcaaggtcacggtttgctgtggggttcctgggagagcttactcaccccggagtcttttctttctcttgctccaagaagagccctgttggtgctttaccaccgcttggagtctcccgaggacacaaacaggcagagagggacgtgtagggagagttctttcctgttttctgtgctttcctttttacaggactcccggaaggccactcatggccatgccaggagctttctcagaaacagtcataaacgatctcttgagtctctttcttgtcctcccagctgagctttcttattccaccctttctggtgtctataggaatgcatgagagaccctggacgtttttctgctctcttctggccctccatggagtcatgggcctcggcctcggcggctcctcaccctcacaatttatttcctcctcccgtgccagcccttcttttgtgtctgaaaccggttttaaaatgtgactctcccagagaagaagccgctggctgtatgaaacttgacggcgcttttgtaaggtgccacccccaaactttaaggtagctaaaccaatttttaaaagattcaatggcttgttcatcctccagatgtagctattgatgtacacttcgcaacggagtgtctgaaattgtggtggtcctgatttataggatttcataattaaaatgtctgctgaataaatttggcttttgttttggaaaaaaaaaaaaaaaaaa

SEQ ID NO: 27772 - DNA, 1840 bp, Homo sapiens
gaggccttgtaggcacagcggctgagactcgatctgctccaagtaggggctccagcgcgggtcggagtctgggggttcgcgcccgccgacccgcgccctgctccctctcagcacctgggcggacggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcaagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgttagcctggaaatgaaattaaaaaaaaaaaaaaaaaaaaaaaaaaaaaaaaaaaaaaaaaaaaaaaaaaa

SEQ ID NO: 27773 - DNA, 1883 bp, Homo sapiens
ccctttccccactgtggtgtgataagaggctgccctcacagtcacaatgctcccgggtcacagaggtgctgggccccaggccagcctctgcctgggaagttctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccagaggcgccacagggcagtaatggctgatgggcaccccctggagtctgacacgttcttccgaatgcactggaactgtggcaggatcatcctgcagtcctgcagggggcgcttcctgggcattgcacccaacagcctgctgatggccaatgtcatccttccaggcccaaatgaggaatttgggattttatttgccaatcgctccttccttgtattgcgaggtcgttatggctatgtgggctcctcatcgggccatgacctcatacagtgcaaccaggatcagcccgaccgcattcatctactaccctgccgaccgggtatctaccacttccaggcacaggggggatccttctggtcaataacatcctttggcacctttcgcccttggggcaagtttgccctcaacttctgtatcgagcttcaggggagcaacttactcactgtactggcccccaatggcttctacatgcgagccgaccaaagtggcaccctgttggcagacagtgaagacattaccagagagtgtatctgggaattttaggtcaatgggatgtcacctaccaaaatccaaatcctccaggaaaaactactacactaaatggaccaggaacctcagagtcaagatccaagagaagaacatctgttacaacttttcctacccagtttagcaaaacacctgttttatgcaacaatacatcacaacaggcc

SEQ ID NO: 27774 - DNA, 2888 bp, Homo sapiens
ggttgccagggaaacagcggtcccacaggcaggagggatctggaccggcggcttcttccactaccagagaggctgaggtggcgggagagacccctctcctctgggggtaagtggctggcgcggcgagtgtctgcggcgcgcttctgcggccatctgcgccctgactgacggcggccagttcctcgaggaggcccggcgggaaggatttcaatggatattataaagggaaacctagatggaatttcaaaaccagcttcaaattcaagaatacgccctgggagcagaagttcaaatgcttctttggaggtgctctcaacagaaccaggatccttcaaggtcgatactgcaagcaacttgaactctggtaaagaggaccactccgaaagcagtaatacagagaacagaagaactagtaatgatgataagcaggaaagctgctctgagaaaataaaattggctgaagagggatcagatgaagatctggatttggttcaacatcagataatctctgagtgttcagatgaacccaaattaaaagaattagattctcaacttcaagatgctattcagaagatgaaaaaacttgataaaatattggcaaagaaacaacgcagagaaaaagaaattaagaagcaaggtctagaaatgagaataaagctgtgggaagaaattaagtctgcaaaatatagtgaagcttggcaaagtaaagaggagatggaaaatacaaaaaaatttttatctttgactgctgtttctgaagaaactgttggtccttctcatgaggaggaagacaccttttcctcagtgtttcatactcaaatccctccagaagaatatgaaatgcagatgcagaaactcaataaagattttacctgtgatgtggaaagaaatgagtcattgatcaaatcaggaaagaaacctttctcgaatacagaaaagattgagctcaggggtaaacacaaccaggattttattaagagaaacattgagttggccaaggaatcaagaaacccagtggttatggttgacagagagaagaaaaggctggttgagcttttgaaggacttggatgagaaagattccgggctctccagttctgagggtgatcagtctggctgggtggtcccagtaaaaggatatgaacttgcagtcacccagcatcagcagcttgctgaaattgatataaaactccaagaactctctgcagcctcccctacaatttccagtttttctccaagacttgaaaatcggaataatcagaaacctgaccatgatggtgaaagaaatatggaagtaactccaggagaaaagatacttaggaacaccaaagagcaacgcgatctgcataatcggctgagagagattgatgaaaagctgaaaatgatgaaggaaaatgtgttagagtccacatcacgtctctctgaagaacagttaaagtgtcttctggatgaatgcatacttaaacaaaaatccatcattaaactttcttcagaaagaaaaaaggaagacattgaggacgtaacacctgtgttcccccagctttccaggtccatcatctctaaattgctaaatgaatcagaaacaaaggtccagaaaactgaggtagaagatgcagatatgcttgagagtgaagaatgtgaagcttctaaaggctactatctcactaaagccttgactggacataatatgtcagaagctcttgtcactgaagcagagaatatgaaatgccttcaattttccaaggacgttattattagtgacacaaaagactattttatgtcgaagactcttggcattgggagactgaaaaggccctccttcttagatgatccactgtatggtatcagtgtgagcctttcatcagaagaccaacatctgaaactcagttctccagagaatacaatagcagatgagcaggagactaaagatgcagcagaagaatgtaaagaaccctaatcaaggacttgctgggtgtgcttttcagaaagttggtaatgaagttaaattaaatttcttattgaattatttgaattcaatgaatgcactgcagagactattctttattgattttgacatttggagtcgctctttgtggattatatttccttgatatttttgagacttggggtgtaattgttcagtggtttttgctcattaaaatttctgggaccattgtttataaatttattgctaatcttacagtattaggattcattataaaaaccaacattttaatgtatacgtgttagggtaaaactcgttgaagtgctgtgattgtcctgtattcaattttgtatgtttcacctctactgtgattcagacagatcatggtggtcactgggaatttttgctgtggccctgcttttccttcttcccacttgtctcatgtctgtgaaactggtacaacctgccataagatgaaatgaattgtctcaacaaagcaatattagaagagcctttactatcttattggtgatgacacgtttcttaagtaggagtttgagtgaattatttgatatattactttgttaataatagttaacaatagtttcttattttctttcagagtttgggccttttagattgcatcaaataaaaatgagctactttaaaagacagtctgcggtactattttaagagagatggtttagttacaagtcagtaacttagattcatgagaaaattttgtgttgacattccataagatgagttggcattagaattggaagtccagtttatttctgaatcaaaaaatgagcgggctattgtgctgcctttaataaaatttgagtgatgtatacataaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 27775 - DNA, 894 bp, Homo sapiens
ggcggcgctatgctgtcctgcttcaggctcctctccaggcacatcagcccttcgctggcgtctctgcgcccggtgcgctgctgcttcgcgctcccgctgcgttgggccccggggcgccccttggaccccaggcagatcgccccccgccgccccctggccgcagccgcctcctcccgggaccctaccgggcccgccgccggcccctctcgggtgcgccagaacttccaccccgactccgaggctgccatcaaccgccagatcaacctcgagctctatgcgtcctacgtgtacttgtccatggcctattacttctcccgggatgacgtggccttgaacaacttctccaggtatttccttcaccagtcccgggaggagaccgagcacgcggagaagctgatgaggctgcagaaccagcgaggaggccggatccgcctgcaggacatcaagaagccggaacaggacgactgggaaagcgggctgcatgccatggagtgtgctctactcttggaaaagaacgtgaaccagtcgttgctggaattgcacgctctagcctcagataaaggtgacccccatttgtgcgatttcctggaaacctactacctgaatgagcaggtgaagtctatcaaagaactaggtgaccacgtgcacaacttagtgaagatgggggccccggatgctggcctggcggagtacctttttgacacacatacccttggaaatgaaaacaagcagaactaagccacgagctgccttcctcccaggctagtggatccaaagaccaaagtcagctgtctcctgctttcttgcccttaaaatcacctccatctttatattcttctgttatactattcctccaataaagtgatttgtagaaaaaaaaaaaaaaaaaaaaaa

SEQ ID NO: 27776 - DNA, 1536 bp, Homo sapiens
tgaattcgtgagatggcgagctccacggcaccatggccccgaagctgctgctcctcctctgcctgttctcgggcttgcacgcgcggtccagaaaggtggaagaggatgaatatgaagattcatcatcaaaccaaaagtgggtcttggctccaaaatcccaagacaccgacgtgactcttattctcaacaagttgctaagagagtatgataaaaagctgaggccagatattggaataaaaccgaccgtaattgacgttgacatttatgttaacagcattggtcctgtgtcatcaataaacatggaataccaaattgacatattttttgctcagacctggacagatagtcgccttcgattcaacagcacaatgaaaattcttactctgaacagcaacatggtggggttaatctggatcccagacaccatcttccgcaattctaaaaccgcagaggctcactggatcaccacacccaatcagctcctccggatttggaatgacgggaaaatcctttacactttgaggctcaccatcaatgctgagtgccagctgcagctgcacaacttccccatggacgaacactcctgcccgctgattttctccagctatggctatcccaaagaagaaatgatttatagatggagaaaaaattcagtggaggcagctgaccagaaatcatggcggctttatcagtttgacttcatgggcctcagaaacaccacagaaatcgtgacaacgtctgcaggtgattatgttgtcatgactatatattttgaattgagtagaagaatgggatacttcaccattcagacatacattccctgtatactgactgtggttttatcctgggtgtcattttggatcaaaaaagatgctacgccagcaagaacagcattaggcatcaccacggtgctgaccatgaccaccctgagcaccatcgccaggaagtccttgccacgcgtgtcctacgtgaccgccatggacctttttgtgactgtgtgcttcctgtttgtcttcgccgcgctgatggagtatgccaccctcaactactattccagctgtagaaaaccaaccaccacgaaaaagacaacatcgttactacatccagattcctcaagatggattcctgagcgaataagcctacaagccccttccaactattccctcctggacatgaggccaccaccacctgcgatgatcactttaaacaattccgtttactggcaggaatttgaagatacctgtgtctatgagtgtctggatggcaaagactgtcagagcttcttctgctgctatgaagaatgtaaatcaggatcctggaggaaagggcgtattcacatagacatcttggagctggactcgtactcccgggtctttttccccacgtccttcctgctctttaacctggtctactgggttggatacctgtatctctaagtgttgctcagagtgaagagtgaagagcatttggtacacacttgaccttctgtcgtccccagaccagtagtgaccaatcgggagtagcaaggaaggacac

SEQ ID NO: 27777 - DNA, 2135 bp, Homo sapiens
ttcccacaaaagctaggctggttctgattcttaacctgctccagcagtgacacactcagtcccacagggagtggacgacccccaggaagaagatgatgttttggaggaaactccccaaagccctcttcattgggctgactctggccattgctgtcaatctccttctggtattttctagcaaggggactttacaaaacctgtttacgggtggtctccacagggagcttcctttacatctgaataaacgctacggggcagtgataaagagactctcccacttggaggtggaattgcaggatctgaaagaaagtatgaaattagctctgaggcaacaagaaaatgtgaacagcacactgaagagggcgaaagatgaagtacgccctcttctaaaggcaatggaaaccaaggtgaatgagacaaagaagcacaaaacccaaatgaaactcttcccacactcacagcttttcaggcaatggggcgaggatctttctgaggcccagcagaaggcggcccaggacctcttccggaagtttggttacaacgcgtacctcagcaaccagctgcctctcaatcgcaccatccccgacacgcgagactacagatgtcttcggaagacatatccttcccaactcccatccctcagtgtcattctcatattcgtgaatgaagctctgtccattatacaacgggccatcaccagtatcatcaaccggacgccctctcgattgttgaaggaaatcatcttggtggatgatttcagctcaaatggagaactaaaggtacacttggatgagaagattaagctttacaaccagaagtatccaggactactgaaaataatacggcatcctgaaaggaaaggtcttgctcaagcccgcaacactggctgggaagctgccacagcagacgtggtcgccatcttggatgctcacattgaagtcaatgttgggtgggcagagccaatcttggctcggattcaggaggaccgcactgtgattgtgtctcctgtgtttgacaacattcgttttgacaccttcaaactggataagtatgaactggcagttgatgggtttaactgggaactctggtgccgctacgatgcactgccacaagcctggattgatctgcatgatgtcactgccccagtgaagagtccttcaatcatgggcatcctggctgctaacaggcacttcctgggagagatcgggtctctggatggtggaatgctcatctatggaggagagaacgtggagcttagcctgagggtgtggcagtgtggagggaaggtcgagattttgccctgttcccggattgcccacctagagagacaccacaagccctacgccttggatctcaccgctgccttgaagcgcaatgctctgcgagtggccgaaatctggatggatgagcacaaacacatggtctacttggcctggaacatacctctccagaactctggaatagattttggagacgtttcttccagaatggcactccgggaaaaactgaaatgtaaaacttttgactggtacctgaaaaatgtttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgggaggagctgtcataaacagagataccaagcggtgtctggagatgaagaaggatcttttgggtagccacgtgcttgtgctccagacctgtagcacgcaagtgtgggaaatccagcacactgtcagagactggggtcagaccaacagccagtgatcctcagatggtgctggatctgggtcatcaattcttgcaagtggaatggcttctactcctaacactcccagcttctttctcaatgagaaagaaagcatgtgtatgtctgtttatggcgacttcaggtgg

SEQ ID NO: 27778 - DNA, 1696 bp, Homo sapiens
actgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaagggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatgcgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgaccaaaaaaaaaaaaaaaa

SEQ ID NO: 27779 - DNA, 2890 bp, Homo sapiens
ggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaaacccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtcaacttggtaacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggcctcccctgaacgctacctcggcttgccaggatccctgaagtgggaggacagaggtccaagtgggcaagggcaggggcagttcttgatacagcaggtgaccctgaaaattccattttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggctttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtgggactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggccacaggctttctttgggagcagtacagtgaccgcgatgggcgaggcatgtgccgccctttccacggctggaccagccttgtcttactggccatggctgaagactactgaagggagggagaggaggggagccaagacactcatgccactctggctctgaaggacaagggacaaaggcttctggcttttgcccccagccccttggataccagtaattcaaaccttcctcattcattctcaggtgtctccttgctgtcatcccacatagccctggggtgaatgtgaatccagagtctatttttctaaataaattggaaaaaacaaaaaaaaaaaaaaaaaaaaaaaaaaaaaaaaaaaa

SEQ ID NO: 27780 - DNA, 1374 bp, Homo sapiens
agcgccaagagagaaagagcacatatttctccgtgggacactccttgtattggtgggtgagaaatgggcgactggagtttcctggggaacatcttggaggaggtgaatgagcactccaccgtcatcggcagagtctggctcaccgtgcttttcatcttccggatcctcatccttggcacggccgcagagttcgtgtggggggatgagcaatccgacttcgtgtgcaacacccagcagcctggctgcgagaacgtctgctacgacgaggcctttcccatctcccacattcgcctctgggtgctgcagatcatcttcgtctccaccccgtccctgatgtacgtggggcacgcggtgcactacgtccgcatggaggagaagcgcaaaagccgcgaggcggaggagctgggccagcaggcggggactaacggcggcccggaccagggcagcgtcaagaagagcagcggcagcaaaggcactaagaagttccggctggaggggaccctgctgaggacctacatctgccacatcatcttcaagaccctctttgaagtgggcttcatcgtgggccactacttcctgtacgggttccggatcctgcctctgtaccgctgcagccggtggccctgccccaatgtggtggactgcttcgtgtcccggcccacggagaaaaccatcttcatcctgttcatgttgtctgtggcctctgtgtccctattcctcaacgtgatggagttgggccacctgggcctgaaggggatccggtctgccttgaagaggcctgtagagcagcccctgggggagattcctgagaaatccctccactccattgctgtctcctccatccagaaagccaagggctatcagctcctagaagaagagaaaatcgtttcccactatttccccttgaccgaggttgggatggtggagaccagcccactgcctgccaagcctttcaatcagttcgaggagaagatcagcacaggacccctgggggacttgtcccggggctaccaagagacactgccttcctacgctcaggtgggggcacaagaagtggagggcgaggggccgcctgcagaggagggagccgaacccgaggtgggagagaagaaggaggaagcagagaggctgaccacggaggagcaggagaaggtggccgtgccagagggggagaaagtagagacccccggagtggataaggagggtgaaaaagaagagccgcagtcggagaaggtgtcaaagcaagggctgccagctgagaagacaccttcactctgtccagagctgacaacagatgatgccagacccctgagcaggctaagcaaagccagcagccgagccaggtcagacgatctaaccgtatgaagtgacgcc

SEQ ID NO: 27781 - DNA, 1899 bp, Homo sapiens
agccgacctactggtgtcatggcagccccaaagacagcagctgtggggccgttggtgggagcggtggtccagggcaccaactccactcgctttctggttttcaattcaaaaacagcggaactacttagtcatcacaaagtggaattaacacaagagttcccaaaagaaggatgggtggaacaagaccctaaagaaattcttcagtctgtctacgagtgtatagcgagaacgtgtgagaaacttgacgaactgaatattgatatatccaacataaaagctgttggtgtcagcaatcagagggaaaccactgtaatctgggacaagttaacaggagagcctctctacaatgctgtggtgtggcttgatctaagaacccagactactgttgaggatcttagtaaaaaaattccaggaaatagtaacttcgtcaagtctaagacaggccttccactcagcacttacttcagtgcagtaaaacttcgttggatgcttgacaatgtgagaaacgtccaaaaggctgttgaagaaggtagagctctttttggtaccattgattcatggcttatctggagtttgacaggaggagttaatggaggcgtgcattgtacagatgtaacaaatgcaagtaggacaatgctttttaatatccattctttggaatgggataaagagctctgtgacttttttgaaattccaatggaccttcttccaaatgtcttcagttcttctgagatctatggcctaattaaaactggagccctggaaggtgtgccaatatctgggtgtttgggggaccaatgtgctgcattagtaggacaaatgtgcttccaggagggacaagccaaaaacacctatggaacaggttgcttcttactgtgtaatacgggtcgtaaatgtgtgttttctgaacatggccttttgaccacagtagcttacaaactaggcagagagaagccagcatattatgcactggaaggttctgttgctatagcaggtgctgttattcgttggctaagagacaatcttggaattatagagacctcaggagacattgaaagacttgctaaagaagtaggaacttcttatggctgttactttgtcccagccttttcagggttatatgcaccttattgggagcccagtgcaagagggatactctgtggcctcactcagtttaccaataaatgtcatattgcttttgctgcattagaagctgtttgtttccaaacccgagagattttggaagccatgaaccgtgactgtggaattccacttcgtcatttgcaggtagatggaggaatgaccaacaacaaagttcttatgcagctacaagcagatattcttcatattccagtaataaaaccctttatgcctgaaacaactgcactaggagctgccatggcagcaggggctgcagagggagtaagcgtttggagccttgaaccccaggctttgtcagttctcaggatggaacgatttgaaccacagatccaggccacagaaagtgaaattcgttatgccacatggaagaaagccgtaatgaagtcaatgggttgggttaccagtcagtctcctgaaggtggtgatccttctatcttctctagtctgcctttgggattttttatagtgagtagcatggtaatgctaattggagcaagatatatctcgggtgtgccataataataccagctatggagtcccaagatgtaaacattttacataatgaaagcatatagcagttctgcctcttaatataatgacactattatagactctgattttgtttataaaccacttgctacatgacccatgaaaaccctagacttgtgacctgaaataaagaaaatacgttagaagagcactgtaaaaaaaaaaaaaaaaaaaaaaaaaaaaaaaaaa

SEQ ID NO: 27782 - DNA, 1796 bp, Homo sapiens
tgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttcttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccactaaaaaaaaaaaaaaaaaaaa

SEQ ID NO: 27783 - DNA, 2957 bp, Homo sapiens
agcgtggctgcgcgtgagaaggtggcggtgtaggcacctgcgctcggggaaggctggcggcggcggccgggccatggccagagaccccctcctctgggctccctgaagtcctggggagccgtgacccatgggatcgtcgagcagccgggtgctgggccagccgaggcgagcccttgcccagcaggaacagggtgccagggccaggggctcggcccggaggccggacactggagacgatgcggcgagctacggcttctgttactgcccgggcagtcacaagcgcaagcggagcagcggggcctgccgctactgtgacccggactcgcacagggaggagcatgaggaggagggggacaagcagcagccgctcctcaacacccctgcaaggaaaaaattaaggagtacatccaaatatatttatcaaacattatttttgaatggtgaaaacagtgacattaagatttgtgctctaggagaagaatggcgattacacaaaatatatttatgtcaatctggctacttttctagtatgttcagtggttcttggaaagaatccagcatgaatattattgaactggagattcctgaccagaacattgatgtagacgcactgcaggttgcgtttggttcactgtatcgagatgatgtcttgataaaacccagtcgagttgttgccattttggcagcagcttgtatgctgcagctggatggtttaatacagcagtgtggtgagacaatgaaggaaacaattaatgtgaaaactgtatgcggttattacacatcagtagagatctatggattagattctgtaaaggaaaagtgccttgaatggcttctaaacaatttgatgactcaccagaatgttaaactttttaaagaactcggtataaatgtcatgaaacagctcattggttcctctaacttatttgtgatgcaagtggagatggatgtatacaccactctaaaaaagtggatgttccttcaacttgtgccttcttggaatggatctttaaaacagcttttgacagaaacagatgtctggttttctaaacagagaaaagattttgaaggtatggcctttcttgaaactgaaccaggaaaaccatttgtgtcagtattcagacatttaaggttacaatatattatcagtgacctagcttctgcaagaattattgaacaagatggtatagtaccttcagaatggctgtcttctgtgtataaacagcagtggtttgctatgctgcgggcagaacaagaccatgaggtagggcctcaagaaatcaataaagaagacctagagggaagtagcatgaggtgtggtagaaagcttgccaaagatggtgaatactactggtgttggacgggttttaacttcggctttgacctacttgtaatttacaccaatggatacatcattttcaaacgcaatacactgaatcagccatgcagcgggtctgtcagtttacggcctcgaaggagcatagcatttagattacgcttggcttcttttgatagtagtggaaaactagtatgtagtagaacaactggctatcaaatacttatacttaaaaaggatcaggaacaagtggtgatgaacttggacagcaggtttctgaccttccctttatatatctgctgtaacttcttgtatatatcaccagaaaaaggaattgaaaataatcgccacccagaagatccagaaaactgaagatctcatcagttggaaacagtagcactttgaaaactttcaggccagctttaatttaatggccctactgatattcacatctaaggtgactaacaatgacaaaggccttatgaactgtacggacaatacagaagactattcttatcctcattgcatttctatgcatatacaaaaaaaaccattttaaagccaagaaaatatctgtcaaaccatttctgtcagtacgatgtaaactcatgcttttaattcagcatcagcagaaaatgactgtaggtaaatctcacatttatctgcaacaaaatatagatttaatttttagcttaaactttgtttctaccttatgttagtggacctcagttatctatctgtaaatttatttttatttggctaaaataatctaaaagaataatttggatggccaattagcaatgctcttttgagctggggcatttaaagctttcctttaatatttttacctgctcattatgattcctccttttagtctaatatctttccagttcatacttgtttttaatcattaaatactttcttcctggtttggagactaagctgagaaactttttttaaacttaagcattgtcatatgctatttttttaaaatttggctttcctaggattttaagaacaatgaaagttagcttcacaccttcaaatgatcttgaatgagtgaaaaatcagtttgattccagggatatttcttgtcttacatggtcttttctttgacagtctgtacacctttattattagtttttgagttatttatgtaccagatattatacttttaaacattttaatattctctgatctttacaattatttatgttcaaattttagttgggagttttgtttcctacttaagctcaggacttgataccctctgagttgagtggctttgagtgacatgctaacagcaatttcatagtaaatgtaaataaggtcagaggatctaacatagaagctgatgacgcattaatgtaaaaatggaacttatttttgtcaaaaataagatgtacacttgtcatgttttatatacgttgaccttttgtgtttattgctgttttgaatagagccatgttcattttctttccagttagagtaagtacttctgtggttaatgtatatttttattctggcttttaaaatgggaataatttgtatgtatctgtgcaaataataaatgcgcatttggaaaaaaaaaaaaaaaaaaaaaataaaaaaaaaaaaaaaa

SEQ ID NO: 27784 - DNA, 1540 bp, Homo sapiens
gccctcggccccgggccggcccgccccgcctcggccgccgcctggcgagccgccgggtccccgctcggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtccccagcgggagccccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgccccaggcccagggagacgggatggagacacggggcaggaccttccttccacggagcctgcgctgccgggcgggtggcgctgccgagtccgggccggggctctgccgcgggaggagattttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttct

SEQ ID NO: 27785 - DNA, 2891 bp, Homo sapiens
gcttcccttccacgtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagacttttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagtttttttttataattcagtctgcttttggattttcatatatttaactttgcaaaaagatttactttgtacatgttacaggcttgattggtgtaaatctttttataaatacataaataaaagaaaaatatgcatttttcttttct

SEQ ID NO: 27786 - DNA, 5244 bp, Homo sapiens
acagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaagaaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctccgcctggttagatctctgtcttcctcttcctacaggaaaagaaagcaaacaacgagaaacagaaagctgaaagggggctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagacgctggagaggagcttgtccaaactcaaacaccagatggctgaacccttgcccccagagcccccagcagtgccctctgaggtggagctgcagcacctgaggaaggaactagagagagtggcaggagcgctccaggcccaggtggagtacaatcagcgcataagtctcctgaatgaggggcaaaaggagagacttcgggagcaggaggagaggcttcaggagcagcaggagaggcttcgggagcaggaggagaggcttcagcagctggccgagccacagaacagcttcaaggagctgaacaatgagaacaagagcgtactacagttggagcagcaagtaaaggagctgcaggagaagctaggcaaggtgaaggagacggagcgcctggaagctgccagccagcagaaacagcagctaacggcccagttgagcctcatggctctccctggggaaggacacggaggagaacatctggacagtgagggggaggaggcacctcggcccatgccgagtgtcccacaggacctggagagcagggaggccatgagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagagaccagggagggttctccccacgacaagcctactgcacagccgatcgtgcaggaccaccaggagcacccaggcttgggcagcaactgctgtgtgccattcttttgctgggcttggccgccaagaagaaggagataaacatgaccatcgtcaaagagctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggttattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtagttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctatggattaaatcacatactggcatatttaagctgaatgtcaatctggaaaataaattgactgtattaacagaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgatactgtaatgtaataaattattaagttgttgca

SEQ ID NO: 27787 - DNA, 5245 bp, Homo sapiens
acagctacctggtaggtgactggaggtgttgatcagtgcttggtgggattttgctgatgtggccccaagcccgcctccctccccaccctgcaatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaagaaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctccgcctggttagatctctgtcttccacttcctacaggaaaagaaagcaaacaacgagaaacagaaagccgaaagggagctagaggttcaaatccagagattgaacatacagaaagggaaactaaatacggacctgtaccacacgaaacattctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaaaaccagatggctgaacctctgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagaggcttcgggagcaggaggagaggcttcaggagcagcaggagaggcttccagagcaggaggagaggcttcggcagctggccgagccacagaacagcttcaaggagctgaacaatgagaacaagagcgtactacagttggagcagcaagtaaaggagctgcaggagaagctaggcaaggtgaaggagacggagcgtctggaagctgccagccagcagaaacagcagctaacggcccagttgagcctcatggctctccctggggaaggacacggaggagaacatctggacagtgagggggaggaggcacctcggcccatgccgagtgtcccagaggacctggagagcagggaggccatgagcggctttatggaccacctggaggagaaggcagacctgagtgagctggtggagaaagaagaacttggattcttccagtactacagagagggatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatgaccatcgtcaaagagctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcatgcatattgagtttgcccttacgtggtgggagttcaaacacacaaagacccactatttgcacaaaactattcttgctggtttggaataggctgccatgtgtttttaatgttattgaagcatgtatattcattacagaattcagataaaatttgcctatgttctgctattgtttgatctaatcttaatcacagtgagctcttcattagcacaatatgtggtttgccccaagtttgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcagttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctatggattaaatcacatactggcatatttaagctgaatgtcaatctggaaaataaattgactgtattaacagaaataccactctttgtgtagatatttgtcgtatatttaagaaaaagctaaaaagaatggaaatcgcatgactataacttaagtctttcttcaaagtgcattgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgca

SEQ ID NO: 27788 - DNA, 5253 bp, Homo sapiens
agtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtctgtaaaagtcagtcaactgaagaacaccatcaaatctttgaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctaaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagacgctggagaggagcttgtccaaactcaaacaccagatggctgaacccttgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagagacttcgggagcaggaggagaggcttcaggagcagcaggagaggcttcgggagcaggaggagaggcttcagcagctggccgagccacagaacagcttcaaggagctgaacaatgagaacaagagcgtactacagttggagcagcaagtaaaggagctgcaggagaagctaggcaaggagcgcctggaagctaccagccagcagaaacagcagctaacggcccagctgagcctcatggctctccctggggaaggacacggaggagaacatctggacagtgagggggaggaggcacctcggcccatgccgagtgtcccagaggacctggagagcagggaggccatgagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatgaccatcgtcaaagacctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcatgcatattgagtttgcccttacgtggtgggagttcaaacacacaaagacccactatttgcacaaaactattcttgctggtttggaataggctgccatgtgtttttaatgttattgaagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctatggattaaatcacatactggcatatttaagctgaatgtcaatctggaaaataaattgactgtattaacagaaataccactctttgtgtagatatttgtcatatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtaagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaaaaaaaaaaaaaaa

SEQ ID NO: 27789 - DNA, 5244 bp, Homo sapiens
acagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggtgaaggagacggagcgtctggaagctgcgagccagcagaaacagcagctaacggcccagttgagcctcatggctctccctggggaaggagatggaggaggacatctggacagtgagggggaggaggcacctcggcccattcctagcatcccacaggacctggagagcagggaggccatgagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctgaagaaatttttaaaaaagaaacaaagttatggggttaatctcctacacaattcatttacttcatttgaatgttatagccacttatgattatttgtgtttctaatttatagtttaagttcatttgtaaatagttaaaagagagtgggtctctgtggctttcactgatgttcactctggcatactttcgcaattttctttttcaatttcataattgtaggtcattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatgtgcctatgttctgctgttgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcataagaaatcctttaagagttcaaatgtccctggaacaggcatacaagctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaacatcgggtccttgtgacttcaacggactcttccaaattgtatgaatgtatcaatgtattagataaacccagtttcagaatgataaagaaaaaatgttagaccaaataatgcggctagttaacagtggtacgatttctcgcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctgtggattaaatcacatactggcatatttaagctgaatgtcaatctggaaaataaattgactgtattaacggaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagagggcaacattggaaggttagagttcatcagaaacagaattctaaaatgtgagttcaattcaataaatttgaatttctgtaggaagaatcaaatcaccgatttaaagattgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaacagtcattttaaaataactattaaacaatgtaactgctatcttaatgttctgaaataagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgca

SEQ ID NO: 27790 - DNA, 855 bp, Homo sapiens
atggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataa

SEQ ID NO: 27791 - DNA, 5272 bp, Homo sapiens
agtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagtgtactacagttggagcagcaagtaaaggagctgcaggagaagctaggcaaggtgaaggagacggagcgtctggaagctgcgagccagcagaaacagcagctaacggcccagttgagcctcatggctctccctggggaaggagatggaggaggacatctggacagtgaggggaaggaggcacctcggcccattcctagcatcccacaggacctggagagcagggaggccatgagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctgaagaaatttttaaaaaagaaacaaagttatggggttaatctcctacacaattcatttacttcatttgaatgttatagccacttatgattatttgtgtttctaatttatagtttaagttcatttgtaaatagttaaaagagagtgggtctctgtggctttcactgatgttcactctggcatactttcgcaattttctttttcaatttcataattgtaggtcattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatgtgcctatgttctgctgttgtttgatctaatcttaatcacagtgagctcttcattagcacaatatgtggtttgccccaagtgtgcactatttaatactttgtaatatgccaccaagagtactgacatttagagttgtttaaaggccgagaactggaaacagccttttcctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggttgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcataagaaatcctttaagagttcaaatgtccctggaacaggcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaacatcgggtccttgtgacttcaacggactcttccaaattgtatgaatgtatcaatgtattagataaacccagtttcagaatgataaagaaaaaatgttagaccaaataatgcggctagttaacagtggtacgatttctcgcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctgtggattaaatcacatactggcatatttaagctgaatgtcaatctggaaaataaattgactgtattaacggaaataccactctttgtgtagatatttgtcgtatattgaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagagggcaacattggaaggttagagttcatcagaaacagaattctaaaatgtgagttcaattcaataaatttgaatttctgtaggaagaatcaaatcaccgatttaaagattgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaacggtgggaaggaaaagtagagaaagaaatgccaattccagtccaaagctttatttgccaagttttcttagaatgaactttaccaatttatgaattcttgtaagcggaatgtaaaacggaaatactgaaagacttttgcctaaagtggcattattgactgctggtgtgatgctactgtaatgtaataaattattaagttgttgcaaagtgcaaaaaaaaaaaaaaaa

SEQ ID NO: 27792 - DNA, 2823 bp, Homo sapiens
cacccattaggtctccaagacagctgtgtttcacaaacttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagatattgtggaagggaaggtcaacaaaggcatttacctgaaagaggaaaagggagtcacgcttctctattacggcaggtacaacagctcctgcatcagcaagccagagcagtgtggccctgaaggggtcacgttttcttttttctggaagacacaaggagaacagtctagaccaatcccttctgcgtatgggggacaggtcatctccaatgggttcaaagtctgctccagcggtggcagaggctctgtggagctgtacacgcgggacaattccatgacatgggaggcctccttcagccccccaggcccctattggactcatgtcctatttacatggaaatccaaggagggcctgaaagtctacgtcaacgggaccctgagcacctctgatccgagtggaaaagtgtctcgtgactatggagagtccaacgtcaacctcgtgatagggtctgagcaggaccaggccaagtgttatgagaacggtgctttcgatgagttcatcatctgggagcgggctctgactccggatgagatcgccatgtacttcactgctgccattggaaagcatgctttattgtcttcaacgctgccaagcctcttcatgacatccacagcaagccccgtgatgcccacagatgcctaccatcccatcataaccaacctgacagaagagagaaaaaccttccaaagtcccggagtgatactgagttacctccaaaatgtatccctcagcttacccagtaagtccctctcggagcagacagccttgaatctcaccaagaccttcttaaaagccgtgggagagatccttctactgcctggttggattgctctgtcagaggacagcgccgtggtactgagtctcatcgacactattgacaccgtcatgggccatgtatcctccaacctgcacggcagcacgccccaggtcaccgtggagggctcctctgccatggcagagttttccgtggccaaaatcctgcccaagaccgtgaattcctcccattaccgcttcccggcccacgggcagagcttcatccagatcccccacgaggccttccacaggcacgcctggagcaccgtcgtgggtctgctgtaccacagcatgcactactacctgaacaacatctggcccgcccacaccaagatcgcggaggccatgcatcaccaggactgcctgctgttcgccaccagccacctgatttccctggaggtgtccccaccacccaccctgtctcagaacctgtcgggctctccactcattacggtccacctcaagcacagattgacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggagcttgcacgcggacaccaggtggcgctgtcgtctatcagctatgtgggctgctccctctccgtgctctgcctggtggccacgctggtcaccttcgccgtgctgtcctccgtgagcaccatccggaaccagcgctaccacatccacgccaacctgtccttcgccgtgctggtggcccaggtcctgctgctcattagtttccgcctcgagccgggcacgaccccctgccaagtgatggccgtgctcctacactacttcttcctgagtgccttcgcatggatgctggtggaggggctgcacctctacagcatggtgatcaaggtctttgggtcggaggacagcaagcaccgttactactatgggatgggatggggttttcctcttctgatctgcatcatttcactgtcatttgccatggacagttacggaacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacaactacaagatccatggagaccccagtgccttcaagttgacggccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctccgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccag

SEQ ID NO: 27793 - DNA, 3793 bp, Homo sapiens
agcgggcgcgcgctggaggtgggcgcggggcggtgcggtgcggtgcgcgcggggcggtgccgcggcggcggagggagccgcgatggagggcgctccgactgtccgtcaggtgatgaatgaaggggattcaagccttgccaccgacttacaggaagatgtagaggaaaatcctagtccaactgtggaagagaataatgtggtagttaaaaaacaggggccaaatttacataattggagtggtgactggagcttttggatttcaagttccacctataaagacaggaatgaggaatacagaagacagttcacacatctacctgatacagagaggctgatagcagattatgcttgtgctcttcagagggacattttgcttcagggacgactatacctttcagaaaactggctatgtttctatagcaacatcttcagatgggaaactacaatttctattgctttaaagaatataaccttcatgaccaaggaaaaaactgctcgactcatcccaaacgctatccagatagttacagaaagtgaaaagtttttcttcacatcttttggtgccagggatagaagttacctcagtatctttaggttgtggcagaatgtattattagataagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcctcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttaattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctgaaaaaaaaaagaaaaaaaaaaaaaaaa

SEQ ID NO: 27794 - DNA, 2715 bp, Homo sapiens
aggagatgtgccaaactgttaagagtggttatttctgagcagaagaatgtggatgaattccattcttcctatttttcttttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacattaaaaaaaaaaaaaaaa

SEQ ID NO: 27795 - DNA, 2815 bp, Homo sapiens
ccagcgctgctgggaacctacctgtcagcaaaatctcgacacccaaacctcaacataaatcaaacactttcccgggcagagaatgtctgtgtcaggcaagaattagagacaagcggtcagcagagcctcagtgctgatcgtcggagcttgggagcaggaagatgtcgaatgaacttgatttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacattaaaaaaaaaaaaaaaa

SEQ ID NO: 27796 - DNA, 2528 bp, Homo sapiens
aggagatgtgccaaactgttaagagtggttatttctgagcagaagaatgtggatgaattccattcttcctatttttctggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacattaaaaaaaaaaaaaaaa

SEQ ID NO: 27797 - DNA, 1300 bp, Homo sapiens
taaggaactgtgggtagatggtttgcaggaccacatacacacacaaaatagccgactaaagaaagcggtggagatcgagatcagtaagtttgatttgggaacaaaaccctggagactctataggtaggtgactgttgggggtggacaggcgctgaagacttggattggtttagacctagaaggaagtggcatttgattggttattataagtgaaaagggcccctccccgggtgagatatgccagccccataattaggacctgaaaatctctgccaggcctgcctttgtgacgtggcccagtctacctcagctatggaacaggccttgactggtgaggcccaaagccggtggccccgcagaggcgggagtggggccatggctgaggcgcctgggcccagtggcgaatcccgaggacactcagccactcagctgccagcggaaaaaactgtcgggggaccatcgaggggctgctcaagctccgtgctcagagtgtcccagttggtgctccaggccatctccactcacaaagggctgactctggcagctctcaagaaggagctccgaaacgccggctacgaagtgcgcaggaagagcggccgccacgaagcgcccagggggcaggccaaggccacgctcctccgggtcagcggcagcgacgccgccggctacttcagggtctggaaggttcccaagcccaggagaaagccgggacgcgcgaggcaagaggagggcacgcgcgctccctggaggaccccagccgcgccccggagctcccggaggcgccgccagccccttcgcaaggcggccaggaaggccagagaagtgtggagacggaacgcgagggcgaaagccaaggccaatgccagggcgaggaggaccaggagggcaaggccgagagccaaggagccgccgtgtgccagagccaaggaggaagcgggagcgacagcggcagacgaggggcgaggacaggccgtgaaggaagacaccacgccgaggtcagggaaggacaagaggcgaagctccaagcccagggaagagaagcaggagcccaagaagcccgcacagcggaccatccagtagccaacgcgggctaaaaccgaccggacatctagcgggcaggggaagactccactaaagacttccacaaagacctcccctaaatctgaaggtcttcctgatccagttgggaatgcatcttgtgggagcagcttcactcccaccacggaccaatgcctttcccccataggccccaagaagagcggctgtcacactcattgaaatgaaatggacctctagacca

SEQ ID NO: 27798 - DNA, 7163 bp, Homo sapiens
tgaccctgaggcattgccgtcgcgcggtgcacagctaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttttccagttaatgctaagaaaagatttggggaaggttataataaaagtattttgtggtgaccataagaatgtccctccccaaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagactgtttatgataagcttttttttttattagcagcgtgatttgtatatcgatggcttaacatatacaacagcatttcttctccctgcaccttttcgtgaacctgacattttgaacataagcaataacatctgtatggtaaagtaggcagattatacatgtgttgcttagtgaatgattaccaagtgaacacacttggtatattgctttaccaaaatacatgtgtagttgtcacttcagattcactgagttaagaaagttttatttaaatattaatattaatcaagaatttaacagatatatgtgacagaaatctaacttcaagtgactgaagcagaaagaaaaatttttgaatgacataactgagaaaattagaggtagctctagctttgattccatttagatcgagcagctcacacaatgttagcaaggactcatctccactctgccttccctggtgctggttttgctctcaaactctatatagaactctcggccgggcgcggtggctcacacctgtaatcaaaacactttgggaggctgagtcgggaggatagcgtgagcccaggagtttgagaccagctaaggcaatatagtgagaccatgtctctacagaaaaaatttaaaaacagatcagctgggtgtggtgccacatgcctgtagtcccagcttctcaggaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacatcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtgtgagggttggaaattcagggtgctgttaggaaggggaaatggattggggtttaaggtagggggagtaaaaacaagaaaccatccactctgtatattatataagactgtgatcgaattaagaattttagtttacagtttagcataaacaaatagtagtagaaatgaatgcatttattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacatgcccaagcttggttatgctctgatttcctaccctgttactttcatccataatttatagtacatccattttgtgtcattttgcttcaggtatttcttgtcctgactgtcttcttttttatgattttactgtttcttcacactaatggctttgtcctctgactttgactctttgtgagattcttctgagcagttaacctctaggataatgtggcttgaacacattacagaactatgttttgacttgttagtattattcacacattcatgacaattgagcctctctactgtgagaaatgttttagaggccagtttctaggcatagctgtttttctcccatgagtatgcaaatcaatagttttaaccattgttaaaatgcaatcatagtgacttcagaaaatttggaaaatacagaaaatatagggaagaataaaattaacccacagttctgtcacctaaaggtaactgctgccaatgttttcatgtatttcttttctgtctctccaatgcatttttttacatagttgtgagcgttagccaagttattttcatgttgttatgtaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagcaagggtttcttctggattgagtgctgtcagaaagtggattgagtgctgtcagaaagtgggagtgattttgcaactgggtatcttaatttttatgttgtgggtgggaggaaaggaaagaagcaacagtcacccatgttagccacaagaagaggttggctgtttatggtttgcacagtgactttgtttttatctgtgctcaggcatgattacagtatctcattttatccggattacagtgacctcatctgatgttagagatttgagaattgttaaatgttcagcaggagaacgccaccgcctagtgtgaatgctaggtcagaagctgctttttcacactgaaaccatttaagtatgtacaaataagttaatagtgtaaatgtaggtgtaaaatacaatgcaaaacaaaataatgaagtaagtgaattaaattattgcaccaaatatggggatatgaaatagggaaagaaaagcattaagttacttatagtccataaagggactacattattttgttactctgataatcccataaaacaaagttttaagaatgtttacagtaaccatgaatggaattagtgaaactattcatatcaatgcaaaaaaaaaaaaaaaaaaaagcaaagaaactaagtctgtacagcaaaagatggtaaggaaacaagaaaattaaatgaagacaaaggttgtgattattacagtaaatgaaaataggtttttatctttaaaatgtagactcaaactgcaaagctaatgatatgctatctgcaaaatattcctattttgtaaataaataaaaccatagatttaaagaagaaagggcacagatgtactggggagacaaaaataactgatccgttgggtgtataccatgtgccaagcaattttcatatactcatttaacatgacatatctataattatatgaggcagatattattaacctcagtctatagatgagaagactaaagctcagagggattgctaaaaactagtaaataaattatggaaccatgatttgaatttagatttaagtctgactgaggcatgttcaaagacactacactgcctctccagaaatcaggagtagcaatattaacactggacaaagaatttaaagcaagtaaaaaaaaattaagagaatttcatattaataacaagtataatgcacaataaaactgtaccaaatgacataaaaatgcataatgaaatttattagaaattaaaaattaaagggcatagttacaattattgaggaattctcatagctctgccttatagatcatgtaaacaaacaaggtcatagaggacttaaatagcaaagcagaaaaaaaaaaaaaaaaaa

SEQ ID NO: 27799 - DNA, 4481 bp, Homo sapiens
atgcgcgtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactggagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtgtgctcggaaatctcttccttaactgtgactttctgacaggtggaggatgtggtcaggagtgggaaaaggattcgagacgggaagagggaggggttcaggatgaagagagataatctgtgccacagatgctggccctgcagttagctcccacctagtccgtgcacacacattctaatcccctcccattcctttacatgctgcggccagagaggcctttctcaaagtggaagtctcatcctcacttctctggttacagtgctgggccatggtaacttacaaggcttagcaggaactgtctgcgcactcccccttcctgcccactaccttgtttccctccagttgcgagagaaaacattgattgagcattaactatgtgccaggcttgtcctaagtcctttgcatgtattcactcaaacaatcctcacaacattcctatcacatctcccatttcacagtgagggttctaaagcacgtagtgggtgaggaacttgtccagggtcacacaactaagtgggggtggagaaacatcaaatctaggtggtccaggtggtggccagaacccatcagcacctcactacagctgcctccagtttctcgctctaggaaatactcttccctgtcaactcctgttgtcctctgggctcagttgacatgtcatctccttgaggaggacatcctgagatgctccccgactagggtgggcacccacttccacactccaaatgcctatttgacctgtgtatcgctgcatccccactgcctggcagatagcaggcccctaataaatatgatttgagcaaataaatatagttcttcaaaaaatagggaggacttcttgcttcaggtaatggtaggctaggacatttggaccaaccctcctgcagaaaatagccatttattttgatgcaatatatctggctatgactagagatttcaaatatttggagggctattatgtgaagaactaaacttactctttgtgacatagaggtcagaaattggtcgtttccatagagtatgagagagacagaattgtgctcatcataagtatcttttttaaaagttagacttaataaaatgggctgccttggtaggtggtgagttctctgtcacgaaagagattcagccacttgctctgagaaagcatggagaatatcaacattgtaagggtcgaccacctcatctctgaggccccctcctcacttaggttgccattgcaggtggaacactgggctgagtgtcaaagaacctgggttccacaagctgtgcgaccatggctggttgttttggatctcattcctaatatctgttagttaagctgacccgtcaatactgacccacttcacagagttatgaagggattaaattaggtattacatgtaaatctgttttgtttgctttttgttgttcttttttgttttgcttttttctttgcattatgaaatcccaagtcaactttttccattcttttatttttttaaaaattgacatcatcattataaccacaaaataatttttaaaatggaaaaaaaaaactcacctgcaaccccacaatctaatacaataatcatacttttttccctttattctcctttattgtgaccaaggatgactttgggcattgctgtgaggaactatttcgtttaacaccctactacctgaacatgatgcgtactcagcctttcaccaccccccaagtagctacacatgatgtgataatagtattggtggtggttttagagagttggagagaaaactgaagttggatttgggtaaaagaaaaaagagtgggaattattttttctccattctaaagcccataaagcaatgttaattgttcccacccctctgctattctgtctcctcaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaaacccacactttcccattttgtgcctcccttcctagagttttagccaaaggtttagctaagtaattggttttaccagcgcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggcactgatgagtaaggttggtataagttcctcagatcaacaaaaacccattttcctgtaagtcttacatttagtatttaaggaactaaaacttaaatacattttgtgaaatggttgacacttcactgataatgatttattgcttggattaataaattttccaaaagttgtcttatgtagaatatggtttgcaaccagcagaaccattaatctatactgcaatgatatgcactatgtataattgtttaaaagcctctacttaatgatgtaaaatgctctatttaattacacatttgggtaaactgtatactaacatctgatggcatttttccactgtttgttgcttttttcaaatactttattgtacaaagctgttcttaatatttttcaagtttttttctttgaattttgctaatgttttccttgaattatgagcactgacagaatgtgcttagcacttttggctattcacacagcttttgagcatgatttgcatccaatatttacattgctagcaataataagccatctgtgagttttgtcaaaagttattggggattttttaaattttagaaatgcaaattattgtttctttgaactaactcttatgcagttgcaaaggcatttccagttgttatagtttgtgtacaatatcaggtgttccagattatgattcattattaatatcattgcttccttgttccctctgaggtccagaagattcatgtttacaatatttagaaacaatgttaaa

SEQ ID NO: 27800 - DNA, 4481 bp, Homo sapiens; identical to SEQ ID NO: 27799

SEQ ID NO: 27801 - DNA, 4481 bp, Homo sapiens; identical to SEQ ID NO: 27799

SEQ ID NO: 27802 - DNA, 2034 bp, Homo sapiens
agaaccagctatgtcggcctacggcatgcccatgtacaagagcggggacctggtgtttgccaagttaaagggctatgcccactggccggcggggatagagcgcatgacccagcccaaccgctaccaggtgtttttcttcgggacccacgagacggccttcctgagtcccaaacgcctgttcccgtacaaggagtgcaaggagaagttcggcaagcccaacaagaggcgcggcttcagcgcggggctgtgggaaatcgagaacaaccccacggtccaggcctcctactgcccattagcctcagagaagggcagcggagacgggccttggccggagcccgaggccgcagagggcgacgaggacaagccgacccacgctggtggcggcggcgacgaattggggaagccggacgacgacaagcccactgaggaggagaaggggccgctgaagaggagcgcgggggacccgccggaggacgcccccaaacgacccaaggaggcagcccccgaccaagaggaggaggcggaggcggagagggcggcggaagcggagagggcggcggcggcggcggcggcgacggccgtcgacgaggagagtccgttccccgtggcggtggagaacggcagcgcccctagcgagccgggcctggtctgcgagccgcctcagccagaggaggaggagctccgggaggaagaagtcgcggacgaggaggcctcccaggagtggcatgccgaggcaccgggcggcggagatcgcgacagcctgtagttaccagcgtttccagaagagcccctgccccgttcctgctgcggcctggccgttcttggggaatctgaccacggcgtgcaaactgggactgcctttccctctcctcagcccgtcctcctccaacccgcgctcctttgccctgccgggccccaggatggcaggccacctgactctcacctctgtgcccccagcttccggctccctcttctcccccctctacccgccaccccaccccaccccacccccgcccactcgttgcctgattccgtttccgacttggggttcaggcaggctgttttcacctctagacacccctctccacccctcctgcttccccaggcattatgaacctctgcttaggaatatgggtaggagtgaaaggcctggcagataaagagcagagggcacttgcagggcctgggatgagcagtcttcaagctgtggtagttagcgggcaggagagcgacatcttcctgagctcctgtccatgcctgccatacctgccagcttcagacatttagggaaaaggggcagcatgtggggaatgccccccgccttccacaaatccttttgctgacccaggaagttctgggagttgccgtttttcatcaaaacgtttgggggcttccaagttgtttgtgagatctgaaaacttaactttgcccaatatcctggttggggaccgtgagaaatatctgtcccatttagatctctggggccactgatgggatgccctgggaagatccttggctgccgctttctctccccacagcctcaaggccaccctaccgtcatatatatcactcaggcgtagaagaaaagacacatattttataaaatctttttaataaaaggaagttccaagaagaatttttaagaactacctctaggtgtgcctccacgctggccctagctttcccattgctgttccattgctgagacaaactggaaggctccctttctgtttgaagttttatgacttgtagtcaggctttgctgttcgtcacagtgtcattttccattcaggtaccatcacctggtcccatcaacaggtctagtatgtagctcactgataacagaggaagatgtgtctcctcccaccctcttcctaatggtcattatgcctttctccatctattgtctctttcaccccttcccctctcccttgggctctgatgaaaaattgttgactgcagtttcggaagtttgatctgagaaccaaccatagaatgtttcagttctaggaaataaaaccagttgattaaagc

SEQ ID NO: 27803 - DNA, 2210 bp, Homo sapiens
agacatatgacagaagactgaacaaccagaagttatgaagataggtactgtgggtgttagaaagattcacggcaaaacagggaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgcttaaaaaaaaaaaaaaaaaaaaaaaa

SEQ ID NO: 27804 - DNA, 2178 bp, Homo sapiens
gtgtgtgtggtttttttttttaagtgttagatgtttttgatattttaaaaaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgcttaaaaaaaaaaaaaaaaaaaaaaaa

SEQ ID NO: 27805 - DNA, 686 bp, Homo sapiens
aacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaagaaacaaattcaaggagcagcagccaaatacctatgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggaacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaaccgtaaaaaaaaaa

SEQ ID NO: 27806 - DNA, 2352 bp, Homo sapiens
aagtggtgtctgccagatttccccgctgtaaagttactatttgtccctttccatgttctattcattagtagtgggtggctaagtccagcccacactggagagggggagtgccatctgtttttattcctatcatttcaatttgtttaatcctcatggctttattatcacctcactactttttagagatatggttgtaatgagctagacttgcccaaagttactcagctagtaaatggcaaagctagaatttgaacttatatgtgtctggcttaaaaggccatgttctttccacttcatgttactgccaccaagtaaagaggatctcacagtctccgaggcggaagctccctctcagcttgtctggacagtgtttttcaaatccattcttggagtgtgacccatcagtgggtcatgagaagatgaacactgaagtcttggaaccctgggaatgaacctggaaaaattcaaaatatggtctagtcttaggcaagtttccttgtccagctcagctgctgagaccacatatctggaccctcagtgccctggcaacagctctgtgcaggcaggatgaagcacaggcttaggtcaagcaatcagccgtcaaaatccacactctcacctgtgagtggctgttcaaccttgaacatgttactttttatgttaatgaaactcagttttctagtcctataaatttggggctatcatcaaccattaagtgatattaaacccagtgccacacaggcaagtacctagcagtgtccaaaggcccccagaatgacactttttcatcttttctcttccctccaattgaaagactagtggaatatctgcaattactttgaccaaaagccagaagccggccagtttgagtgtagctgttacagctttgtgttctaaacctaagaaatggggacccctcacatgagagtggggaggcttctggatgtgctacaaattccatttcattttcatgaactccagtgttaattaataaaatctcaaggttctcccccctctttcgcctcacatttcttcagagaaatgaagagttccaactcatagcccaagtgctcaggttttaaattagacaactttgtcctgacaggaaccaagtcacagctgtcatacctgattacttttagagttactactaaaccctttgtatggcatgagctgccactgttcaaggcaaacagaaacacttcacattttatcatgacagccctggatctatccacctccccatgttcattatgctcagcctgtctttggaagggatgatgaggcatcctgaaaatcgtatagtgaggaaggcagaccccatggcctgtcactacagcctagggattttaagcccctaaagtgcagcaaaacccactgcctccaggaagccaaggagaattatttctgggggacatagctgcctcatagcctactatgaatgaaccatcatctttcatgagaggcaaacattgaccctcaagtaaccaaccaatacgagcacctgtacacaaatgcccacaggtgttggctgggattggctggcttgtggatgatgtcacagtttccctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctatgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggaacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaaccgtaaaaaaaaaa

SEQ ID NO: 27807 - DNA, 2097 bp, Homo sapiens
ctcgaaggctgcgactggcgccgcctcaccgcctcccaccgccactgaccgaccgttcgaccggcaaacatggttgaagcggatcgcccggggaagctgttcattgggggcctcaacctcgaaaccgacgagaaagccctcgaagccgagtttggcaagtatggccgcatcgtcgaggtgctcctgatgaaagaccgagaaaccaacaagtcgaggggcttcgcgttcgtcacctttgaaagccccgcagacgccaaggccgccgccagagacatgaacggcaagtccctggatggtaaggccatcaaggtggcccaggccaccaaaccggcgttcgagagcagccggcggggcccgccgcctccccgcagccgcggtcgcccgaggttcctgcgcggaacccgcgggggtggcggcggcccgcggcgttccccatcccggggcgggcccgatgatgacggcggctacgcggcggatttcgacctgcggccctccagggccccgatgcccatgaagcgtgggccgccgccgcgcagggtcggcccaccccccaagagggccgcgccgtcgggcccggctcgcagcagcggcggtggaatgcgcgggagggccctggccgtgcgggggcgagacggctactcaggcccaccgcgccgggagccgctgcccccgcgccgcgacccctacctgggcccgcgggatgagggctactcgtccagagacggctactcgagccgagactaccgcgaaccccggggttttgccccctcgcccggagagtacacccaccgcgattacggccactccagtgtccgggacgactgtcccttgagaggctacagcgaccgagacggctacggaggtcgcgaccgtgactacggggatcatctgagcagaggctcccatcgagagccctttgagagctacggagagctgcgcggcgccgccccaggacgggggacaccgccatcttacggaggaggaggccgctacgaggagtaccggggctactcacccgatgcctacagcggcggccgcgacagttacagcagcagttatggccggagcgaccgctactcgaggggccgacaccgggtgggcagaccagatcgtgggctctctctgtccatggaaaggggctgccctccccagcgtgattcttacagccggtcaggctgcagggtgcccaggggcggaggccgtctaggaggccgcttggagagaggaggaggccggagcagatactaagcaggaacagacttgggaccaaaaatcccttttcaacgaaactaacaaaaagaagaacctgttgtatggtaactacccaaggactagtacaaggaagagttgtttttaccttttaagaatttcctgttaagatcgtctccatttttatgcttttgggagaaaaaacttaaaattcgtttagtttagttttggaattgttaacgtttctttcaacaagctcctgttaaaagtatatgaacctgagtactagtcttcttacatttacaagtagaaattcgattaatggcttcttcccttgtaaattttcttgataaatgaggcaaacagttctaagatctttgataaacatctgctcacctaaaatggaaaaacggatcattctgctcatttaaaccaactagattttgggtggagagtgggagggattggtgtatgctactcttaagatttcagggtatctttcaaactgaatctttgtttccagtattaaaaagcaaacaaccagcaacaacaacaacaaaagtgatttagatcaaatgtttatgtaaagaaaattattttcactcagtaaatctgaaaagtaaatggataatgttggccatgttttgcctttttgctttttctttgggaatctacaggatcacctgtcccctcactcccaaaagtactatctatgttttgaacaacagtggaatactatatcaaaggtttggccaaccaaccacaaagctacaaaacaagcaaatcccaaatccttcaattgatagcattcattttcactaccaacaaatttattaagaaacaagtagaaaataaatcagtggtcgacttggggaccgtaatggcttc

SEQ ID NO: 27808 - DNA, 2703 bp, Homo sapiens
cgcgccgggaacagccagtcggtgcctaacgcgagtgtatctcgagagagaagcgatcaacagctgccggtctgcgcctgcgcggcgacggggcgtggccgcgggcgagtggggccaaggaggcagccgggagcgggggcgcaggtgttactggttgcgtcgggtcacgtgggcgcgcagcagaccgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaaaaaaaaaaaaaaaaaaaaaa

SEQ ID NO: 27809 - DNA, 2586 bp, Homo sapiens
cgcgccgggaacagccagtcggtgcctaacgcgagtgtatctcgagagagaagcgatcaacagctgccggtctgcgcctgcgcggcgacggggcgtggccgcgggcgagtggggccaaggaggcagccgggagcgggggcgcaggtgttactggttgcgtcgggtcacgtgggcgcgcagcagaccgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggcttcgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaggtcaaagaagatcctgatggtgaatgtgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcccgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaaaaaaaaaaaaaaaaaaaaaa

SEQ ID NO: 27810 - DNA, 1895 bp, Homo sapiens
atgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatctaaggatggttgttctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcagcaaaaaaaaaaaaaaa

SEQ ID NO: 27811 - DNA, 1079 bp, Homo sapiens
cgggcgggcgggcgaagctgggctcggggccaagcgaggtctagccggagcgactgtgccccgcctcctgggcggagcgggcggctccccatggtcagagcctcgtgccggctcggcagcgcccggacgccgagcccagcgcgtcggccccccggcgtgcgggcgtctcagagccgcggaggggccgccgggaccgtttcagcgtggcggcgctggtgctggcgttggccctggaggacggccccgagtgatggctggcgcctgcctcccgggtgtctcccgggtacagatggagtcgtcccgcggccgccggcggcaaggtcggcagctgcgaggccaagagagaccccaggacacacacagctgcctcccggtgcgagaagaagaccccggcttgagagtgagatggcgtttaatgattgcttcagtttgaactaccctggcaacccctgcccaggggacttgatcgaagtgttccgtcctggctatcagcactgggccctgtacttgggtgatggttacgttatcaacatagcacctgtagatggcattcctgcgtcctttacaagcgccaagtctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtgaatacttattttcagtgcatcattactgttccagattcctatgatggatggcagactctttaataaattgcttactgatattatcttaaaaaaaaaaaaaaaaaa

SEQ ID NO: 27812 - DNA, 1185 bp, Homo sapiens
ttttgcagcccgcggcgctttcccctccgcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccggtaccgggcccaaggaccagccgcctgcgctcagacgttcagctgtgccccactcaggtctaaatagcatttccccccttgaattagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgaaaaaaaaaaaaaaaaaaa

SEQ ID NO: 27813 - DNA, 720 bp, Homo sapiens
tcaacatggccctggagctctacatggacctgctgtcagcaccctgccgtgccgtctacatcttctcgaagaagcatgacatccagttcaactttcagtttgtggatctgctgaaaggtcaccaccacagcaaagaatacattgacatcaaccccctcaggaagctgcccagcctcaaagatgggaaatttatcttaagtgaaagttgctgatcccaaagataacaggggaggaagtttcagctgagaagatggagcatgcagtggaagaggtgaagaacagcctgcagctctttgaggagtattttctgcaggataagatgttcatcaccgggaaccaaatctcactggctgacctggtggccgtggtggagatgatgcagcccatggcagccaactataatgtcttcctcaacagctccaagctagctgagtggcgtatgcaggtggagctgaatattggctctggcctctttagggaggcccatgatcgactaatgcagttggccgactgggacttttcaacattggattcaatggtcaaggagaatatttctgagttgctgaagaagagcaggtgaccctaggcgcagcctgtcccgcagggcctggctggcttagcaatctgagccaccttccttaaaggaaatgttaaaaaaaaaaaacaaaaaaacaaaaaaacaactgttctttgcctaataaagaactggaacaaccatca

SEQ ID NO: 27814 - DNA, 1448 bp, Homo sapiens
agataagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagttaaagttctattataatccaaatttcaagcgtggctatccccaacttttagtaagagtgaagagaagaattggtgttaaaaatgcttcacctatatctactttattcaacgaagatttcaacaagaagcattttagagcaggggctaacatggagaatcataattctgccttagctgctgaagctagtgaagaaagtttattttcagcctctaaaaatttaaatatgcctctaacaagggaatcttctgtcagacagataattgcaaattcatctgtccccattagaagtggtttccctcctccttcaccttcaacctcagttggaccatcagaacaaattgcaacagatcaacatgctattttaaatcagttgaccactattcatatgcactctcatagtacctacatgcaagcaaggggccacattgtgaattttattacaaccacaacttctcaataccacatcatatctcccttacaaaatggttattttgggctgacagtggaaccatctgctgttcccacacgatatcctctggtatcagtcaatgaggctccatatcgtaacatgctaccagcaggcaacccgtggttgcaaatgcctacgatcgctgatagatcagctgcccctcattccaggctagctcttcaaccatcaccactggacaaatatcaccctaattacaactgatctgccattaaaagaggaccagattatgaatgacaacagagactaacatttacattgacaaaaaaccctaaaaatttctgcaattatcttattgaacaataaaattgcatgtttacttctaaaaaaaaaaaaaaaaaaaaaa

SEQ ID NO: 27815 - DNA, 3284 bp, Homo sapiens
gccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcatttccattgctgcttatatgcagtgttagccgaattagatttacaagacaatctaagctttccggataattttatatatcaaacatacaggatggatacatagttggcaacagtctaccttatttaaagcttctactgggataaacctcaattcctttattcaggaaaggatactttattgcattattgttgcagaagcatagatttaattgcatctttattttgaaaaacaaatgaaaattgatggggtttaaagctacagaggcactgacctttttctagttattgtattgctacaatttaaatattaaaacaaataagagctttcccaaaaaaaaaaaaaaaa

SEQ ID NO: 27816 - DNA, 3279 bp, Homo sapiens
ccggctcgaagcgcaacgaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtggtttccaaaaaaagacttacagcaaaatgaataatccagccatcaagagaataggaaatcacattaccaagtctcctgaagacaagcgagaatatcgagggctagagctggccaatggtatcaaagtacttcttatgagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagtcatgagcaaactttggttcaaacaagatgataagaaaaaaaagccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagagcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaa

SEQ ID NO: 27817 - DNA, 9090 bp, Homo sapiens
cgagcccagtcgagccgcgctcacctcgggctcccgctccgtctccacctccgcctttgccctggcggcgcgaccccgtcccggcgcggcccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacagagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcgcacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacgcagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaaaa

SEQ ID NO: 27818 - DNA, 3446 bp, Homo sapiens
gggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaaaaaaaaaaaaaaa

SEQ ID NO: 27819 - DNA, 3577 bp, Homo sapiens
gccgtcccgctgttgtaagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcagatgaatggataaagaaaatgcaggacatatggggggaggagccaagatggccgaataggaacagctccggtctacagctcccagtgtgagcgacacagaagacaggtgatttctgcatttccatctgaggcaagaagaataaatgtctctggtggaacttttgctctggtggaactgcttttctagaactggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaaaaaaaaaaaaaaa

SEQ ID NO: 27820 - DNA, 1383 bp, Homo sapiens
gctcaggccccgccctcagacgagcaccgcccgccggctcctcccgcggctcgaatcgccgtctctctcctccccgccccgccgagttctagaattcgccgcgcagctgcttcagcccctcagccccagccggaccctcgggtcctcatccaccctcgcaggcgcaggccgtggctaccccgaagtcaactgtggaggatccttcctggcttccttcagctccatcctgcccttggatctaggtcacccgcttggacccaactatctgaggcccgaatgccccgcagctcccgctgctccctcgcgttctgctgacccccctccgagtcaggacatcccctttagaccccactttaggccctttcagcccaactccaactagccccatctgccgcttccgcacgcaccaaaaaggagactaactacccagccccgtccagtcatgcaggtgcaggatgatggagtcaacctcatcccctttgccaagtgttccagggtggtcagccgatctccacccccaaggttgccttcccagagcctcagacccatgccccagcgttatggagatgtcttctggaagaaccttaatcaaaggcccacccccacttggctggaggagcagcacattccacccatgctgctcccaccccctgaaatgctttggagaagaaagaagaggaggccatgtttggaaggaatgcagcagcagggccttgggggagtccccgcccgggtgagggctgtcacttaccacctggaggacctaagaaggcgtcagagcatcatcaacgaactgaagaaggcccagtggggcagctctggggctgcatctgagccagtggtgcttggcgaagacggctgtggattccccagcaccaatgaataccctgatctggaagaggagagagcaacctatccacaggaagaggaccgttttctcactcctggcagggcccagctgctttggtctccctggagccccctggatcaggaggaggcttgtgcctccaggcagctgcactctctggcctcgttcagcactgtcacagccagaaggaacccccttcacaatccctgggggatggagttggcagcgtctgaagagtaaggagaaaccaccaatgccgagaggctagtggtgccccagggacccaagactagttccgtcactagagtcaccctcattgctgacatgaaggcgtttccccttccttcgtctctccaactgcctttcccatcctctgaactaggcattaacagcccccgtgggctcccatctcaacccaccgctctcacaggagcaccccaagtcctgttttcctccaggccccgctcctggccttgtattctctctgctctgttattaaaaagcaagcaagtgga

SEQ ID NO: 27821 - DNA, 810 bp, Homo sapiens
ccaccatggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcgaccggaggcgaccgtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccaggggagccccagacgctccgctccctgcatgtgtaacaccccttcttgctgtctcttagtaaataaacgacccaaagcagaaaaaaaaaaaaaaaaaaaaaaaaaaaaaaaaaaaaaaaaaaaaaaaaaaaaaaaaaaaaaaaaaaaa

SEQ ID NO: 27822 - DNA, 710 bp, Homo sapiens
atggttggatgaacacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagaggctaaaactccagttctggttgagacacagacagtggacaatgccaatgagaaatcagaaaaacccccagaaaaccaaaagaagctctctgacaaagatacggtagccaccaagatcaaggcctggtggcggggcaccctggtgcgtcgggcactgttgcacgcagccctcagtgcctgcatcattcagtgctggtggcggctgatactgtccaagattctgaagaagaggcggcaggcagcgctagaggccttctcccggaaggagtgggcagcagtcacactgcagtcccaggcccgcatgtggcgcatccgcagacgctattgccaggtgctcaatgctgttcgcatcatccaggcttactggaggtgccgctcctgtgcttcccgggggttcatcaagggccagtacagagtcacagccaaccagctgcatctccagctggagatcttgctggactcagggccttgcattgtgacagagtgtattcccttctcaataaaggaatgaagtggtcttttccaaaaaaaaaaaaaaaa

SEQ ID NO: 27823 - DNA, 622 bp, Homo sapiens
agagaaatcagggctaatgaaccatctaaggacaggccatgagggttcgattttgtaccaaaggcaatttaattttggttataattgaggatgttgaagaaagcattgaatggaagacattgcagaagaagaaacagcagaaaatcaaggaaaaacttagaataagaacaaaagcagctgtaaagatccaggcctggtggcggggcaccctggtgcgcaggacactgctgcatgcagccctcagggcctggataattcagtgctggtggcggatgacgctgtcgagggtgctggagaagaaacggcaggcagctctgatcgcctacgcaaccagagagagggcagtgatcaagctccagtctttggtccgtatgtggcgtgtccgctggcgatactgccaggtgctcaatgccatctacatcatccagggccactggcaatgccacaactgccagacctgcgctctcctccagggccactgtgtggtcacagccactcacctgcagttccacattgagatcatcaactcctaagggctggcaagaagggcactgtgtctactgtccctattaaaggtctaacctggtaaaaaaaaaaaaaaaaaaaaaaaaaaaaaaaaaaa

SEQ ID NO: 27824 - DNA, 1675 bp, Homo sapiens
acagacctgagtataatggagacctctagcctctaatcatgggcactaaaggggattgcagacttgaagggattgaaccaactactgcaagtcatgggcattcaatgttttgtaagagacaaccagtcaattcaaagatgcaggcaggcggagaaggatggccatgttcgccaaagcataatggaagatgttgatgaaaccgcactgttgaaacaaatggagcgggagaaaatgcctcctcctccaaagccaaagcatccagagtggctctgcatccccagtaaaactgtgcctgcaacacgtgggatccagtaagtaggagagtcctcacagggaagaagggaaagaaattcctaggatgctggggtgagggtaccccagaagaatgaccaggcagcaggcttgaagagcagctacccagattacacagtggtgcagcggtccatgaaaaaagcagagttgacggattatccaagttttggtggaaagtttgggataaattagtacaaaccatggcaatcaagagctccaggaaaaacagacaggaaatgcatgaaaggctatgtcacagcaatatgccatgttgctaagccatggacaggatataatcacaatgatggaagccctgaatgcttattgaaccaaaaactgtgatgctataatcatatagagaggagagcagaaggatgggaacaggtaaatcttcacttcatgaaaagaagtcaagaggatcttctttttccttgatgttctgaagctacaagatgacttccaataccatgttgaataggagtggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccaggtattttctctttatccatcaactttgagcctggaaaaggcactgtggcccctggtcatagttgcctttgtgacatcacggccatctctttctccacctttcctgcccctgccaagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgacc

SEQ ID NO: 27825 - DNA, 523 bp, Homo sapiens
ccactgctccaaaccatgggcagtaaatgctgtaaaggtggtccagatgaagatgcagtagaaagacagaggcggcagaagaatagccaaaaaagtgaaccaacccaaatgggtgaatggatagacaacctgtggtacatgcatatcacagactactcttcagctataaaaagtgttgacctaaaaggaagaggctgaggcacaaaatataatttaaagagtttgcttgagacaaagttaagacagctgcctggaagactcagatgcagatttgaatcatcttctggtgtcattttctttcaggctgaaggacttgctttagatttcttgtaagacagatcaactagcgatgaattatctctgtctttgtctggaaatgtctttattttgctttcatttttgaaagacagttaaactggatatggaattctgggtcataagggctcctcccagcccccagcattttagagttgctgttcaattgtcttctggttccattgtttctcattaaaagtcagccaac

SEQ ID NO: 27826 - DNA, 440 bp, Homo sapiens
agggagatgatcacctgaaccactgctccaaaccatgggcagtaaatgctgtaaaggtggtccagatgaagatgcagtagaaagacagaggcggcagaagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgacc

SEQ ID NO: 27827 - DNA, 1675 bp, Homo sapiens; identical to SEQ ID NO: 27824

SEQ ID NO: 27828 - DNA, 523 bp, Homo sapiens; identical to SEQ ID NO: 27825

SEQ ID NO: 27829 - DNA, 440 bp, Homo sapiens; identical to SEQ ID NO: 27826

SEQ ID NO: 27830 - DNA, 7014 bp, Homo sapiens
cggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcagccggggaggggggcggccaccgcccgcgccgggcatcctcaggagccccagagcgcggagggcgcggcgccgccgagcggtgctggcccccgcgggcctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagagtatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgttttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaacaaaaagaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaaatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtgcattgtatttagtctgtattgatcatggatgccctccttaatagccatatgcaataaaataaagtacattatttatgaaatgaaaaaaaaaaaaaaaaaa

SEQ ID NO: 27831 - DNA, 8415 bp, Homo sapiens
tcgttctcatttgggtgtctgcactgttggaagctactgcactgtgtttccacgcagacagagtacagtgggaaaggctttctccagctgatggatggctgttctctttatttggagtatcttactggttatgtaagcgacctcgagagaaattatcctgacccagatcggaggatgcagtagtgcttcagctgcaggatttcttagtcgttaacaccacagtgctgatgacaaagagcgagttgtaatcctcatcactgccagggctgagccagagcagacagaaaatcgtcatttgctcgttggagacttgttaggttacagctcctgcttcgttctgtggtcttggcttttcttcctatacaatgacgccgctgcaagtgagctcagaaatgcttggtttgagagccatttgcctgtgatttttgaagactaaagaagtatttacactagatactcttccagaacaaaatagaaatttcagcaaatacttactgacctttaaagccttgttgtggatttctgagatttaaagatactttaaaattctcaagaacaaagtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagtagatactcacaagataaaatccagcccatcacctgaagttgttaaacccaaaataactcattctcctgattctgtaaagtctaaggccacttatgtgaacagccaagctactggtgaaagaagattggcaaataagatagaacatgagctatcaagatgcagttttcatccaattcctactcgaagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatagaacctgtttaaatccaggtacccatcatcctgccttaactcctgcaccccatttactagccggatcatctagtcaaactccattacctaccattaacactcatcctctgactagtggtccacaccatgctgttcatcaccctcatttacttcccactgtgttacctggagtgcctactgcctccttacttggtggccacccacgactagagagtgctcatgccagcagcttgagccacttagcgctagcacaccagcaacaacaacagttgttacagcaccagtcacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacggtctgttgcatccacatcagccaaaaatgacctggatctaaataggtcacagactggaaaagattgtcacttacataggcattttgtggatccagtattaaatcagttacagaggccaccccaggagactggagagaggttaaacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaatctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaaaaaaaaaaaaaaaaaaaaa

SEQ ID NO: 27832 - DNA, 2988 bp, Homo sapiens
aaggggcggggccgaagcggcccagggggcgggcgtttgaaatcagtgccttagagtagaccctaaacctcattttataccttcaagaaccaattacttaatgtctcttccgtcttttccgtccccgaccccctcccagactccttcattccggtactgcgtggacggaaagccccgggtagccgacaccacgtccccggctagcgggagagagcgtggaaaaggattacaccaaactgtttaaatccaacgactcctgcttccatcctttctcctgagctagaaccaacaaacctagagagttgggcttcggaaaaactagtgttttcatttaattggatatgaagaaagaacaaatatgtacggggcaaccacgatctttacaaagaacataagttccaggaaagcaggaaccttgtctctcttgttcactgggtgtatcctctgcatatagaacagtgcctggcacataataggtgctgaattttgttctaaacactgaggacattctctgctacatttgggtcgtacccccaggtctgagtaattcaatagacttaagaagacagagcccagcagcaaccgaaacataacagagttgcaggatcagctaacgtcaatgcctgggcaaagctgctgcccagagtggaatctcactagtgaataaacaagcccaagaaagattatcatctcatttgcaaaaaaaaaagtacgctggtagatcctgctacctcatagataacaccagtcaaatttttttttaaagtagcattttcctacattgtcaactatctagaacatacctaaaaactaagagtttactgcttattaaatggaaactatgaagtctaaggccaactgtgcccagaatccaaattgtaacataatgatatttcatccaaccaaagaagagtttaatgattttgataaatatattgcttacatggaatcccaaggtgcacacagagctggcttggctaagataattccacccaaagaatggaaagccagagagacctatgataatatcagtgaaatcttaatagccactcccctccagcaggtggcctctgggcgggcaggggtgtttactcaataccataaaaaaaagaaagccatgactgtgggggagtatcgccatttggcaaacagtaaaaaatatcagactccaccacaccagaatttcgaagatttggagcgaaaatactggaagaaccgcatctataattcaccgatttatggtgctgacatcagtggctccttgtttgatgaaaacactaaacaatggaatcttgggcacctgggaacaattcaggacctgctggaaaaggaatgtggggttgtcatagaaggcgtcaatacaccctacttgtactttggcatgtggaaaaccacgtttgcttggcatacagaggacatggacctttacagcatcaactacctgcaccttggggagcccaaaacttggtatgtggtgcccccagaacatggccagcgcctggaacgcctggccagggagctcttcccaggcagttcccggggttgtggggccttcctgcggcacaaggtggccctcatctcgcctacagttctcaaggaaaatgggattcccttcaatcgcataactcaggaggctggagagttcatggtgacctttccctatggctaccatgctggcttcaaccatggtttcaactgcgcagaggccatcaattttgccactccgcgatggattgattatggcaaaatggcctcccagtgtagctgtggggaggcaagggtgaccttttccatggatgccttcgtgcgcatcctgcaacctgaacgctatgacctgtggaaacgtgggcaagaccgggcagttgtggaccacatggagcccagggtaccagccagccaagagctgagcacccagaaggaagtccagttacccaggagagcagcgctgggcctgagacaactcccttcccactgggcccggcattccccttggcctatggctgcccgcagtgggacacggtgccacacccttgtgtgctcttcactcccacgccgatctgcagttagtggcactgctacgcagccccgggctgctgctgtccacagctctaagaagcccagctcaactccatcatccacccctggtccatctgcacagattatccacccgtcaaatggcagacgtggtcgtggtcgccctcctcagaaactgagagctcaggagctgaccctccagactccagccaagaggcccctcttggcgggcacaacatgcacagcttcgggcccagaacctgagcccctacctgaggatggggctttgatggacaagcctgtaccactgagcccagggctccagcatcctgtcaaggcttctgggtgcagctgggcccctgtgccctaagtccacgggctgtctttatatcccactgccctgctgtgtgacagtttgatgaaactggttacatttacatcccaaaactttggttgagtttgcaggactctaggcatgcatgaaagagcccccctggtgatgcccttggatgctgccaagtccatggtagttttcaattttgccatacttttgttcttcctaccggaccctggaatgtctttggatattgctaaaatctatttctgcagctgaggttttatccactggacacatttgtgtgtgagaactaggtcttgttgaggttagcgtaacctggtatatgcaactaccatcctctgggccaactgtggaagctgctgcacttgtgaagaatcctgagctttgattcctcttcagtctacgcatttctctcttcccctccctcaccccctttttcttataaaactaggttctttatacagataaggtcagtagagttccagaataaaagatatgacttttctgagttatttatgtacttaaaatatgttgtcacagtatttgttcccaaatatattaaaggtaaccaaaatgttaaaaaaaaaaaaaaaaaa

SEQ ID NO: 27833 - DNA, 1985 bp, Homo sapiens
gcggctgtttgcgccccttctgcctcccgcgcggccagcaccggtacttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcaggtcacagcaggccagcatggggatgacctcaagctcaccaaggctgaaatctctgagctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgagcagaaggcttcccaactcacccgtctcctccctctccttccctgggctccctttccaagtcaagaaatgctttgtctgtcactacagtcccaaccccatttcctctccctgttgtcctcaaggtgtgatgcttcgatgcaaggagtccagtcaggagctctctcagtggcctccttcttggtcccgtttcgttgggtcattgcctgaaatgcaaagacaacacttacccaggatgtttccccaaggccagctacaagcccctctgcccccatgcctttcttgggccttcactaccaagggactctcttcatcttctgattgggattgtgtccagtcctctgcttcttctgcaataaatgattaaatctg

SEQ ID NO: 27834 - DNA, 3075 bp, Homo sapiens
gagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaa

SEQ ID NO: 27835 - DNA, 1981 bp, Homo sapiens
ctgctcagtgtcaaattaacaggaaagtcagcttaaaggacactccttgcagggactgagctggcacctactccttagagcttgctgataccaggcctgccacgcgacatctgcaaggacagttgtttggtgttttgcttcaggttatagatggagagacctataaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaa

SEQ ID NO: 27836 - DNA, 4488 bp, Homo sapiens
ttggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggctgggacaggaaccgccggaggggaggaggcgccgccggcgctggtggcggaggtagcggggccggcgggggcagtgggggcagcgggggtcgggggactggccagctcaaccgcttcgtgcaactctccgggcggccgcacctgccaggtaagaagaaaatacgatgggacccagttaggaggcgcttcattcagtcctgtcccatcataaggatccctaacaggtttttgagaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacaccaaaaaaaaaaaaaaaa

SEQ ID NO: 27837 - DNA, 6786 bp, Homo sapiens
gaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaagtgtcattggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagtt

SEQ ID NO: 27838 - DNA, 8758 bp, Homo sapiens
ttgcagtggctgcttggcttggcagtggtcgcttggcttggcgtggcagtgatcgcttggcttggcatttctggcttagcggtcctcctttcgcagattggaaaccgcgggctatcctgctgggaggttgtggccgaggcagtagctcgctactgatggtctcctggggtggagaaaagcggggaggggctgaggggtctccgaagccggcagtctacgccacgaggaaaaccggtagcgtcaggagccaggaggaccagtggtacttgggctacccgggggaccagtggtcctcgggcttctcctacagctggtggaaaaacagcgtcggcagcgagagcaagcacggtgagggcgccttagaccagccccagcacgatgtccgcctggaagatcttggcgagctccacagagctgcccggtcgggcgacgtccctggggtggagcacgtcttggttcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggggttgtacttctctcagggaatgatactctccatgacctgtgccaatcacagctaccagaaaacaaagagagcaaagaagcagaacaagacttggagctgacatcagaggaagagcaagaaagacttaaaggatgcgaaaataagcagccacaaaaaacgtctcaagaaccagaaatggctaaggattgtgatagagaggatatacctatatatccagtacttcctcatgtgcaaaaatctgaggaaatgcggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtgaaggatattccctttaatttgacaaataacatacctggttgtgaggaagaagatgcatctgaaatatctgtctcagtggtattcgagacatttcctgaacaaaaagaacccagtctcaaaaatatcatccattcatactaccatccgtactctgggtcccaggaacatgtttgccagtcatcttctaagcttcatttacatgaaaataaattagactgcgacaatgataacaaaccaggcattggacatatttttagtacagataagaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcggaggattgtgaattgtctcactctgtttatgagaattttatgttgctgattgaacaacttagaatggagtataaagattctgctagcctaccaagaatccaagaaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcagaagaaaaggaatcctgagatttctcataggcatcagaaagaaaaggatctctttcatgaaaattgcatgttgcaggaagaaattgccttgctgagactggaaatagatacaataaaaaatcagaacaagcaaaaggaaaagaaatattttgaggacattgaggttgtgaaagaaaagaatgataaccttcaaaaaattataaaacgaaatgaggaaacattaacagaaacaatactccagtacagtggacagctgaacaatctgacagctgagaacaaaatgctcaattctgaactggagaatgggaaagagaaccaagaaagactagaaatagaaatggaatcataccgttgtagactggctgctgctgtacatgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaagcaaactgaagaaatacattgccaagcaggaatctgtagaggagagattatctcaactacaaagtgaaaatatgttgcttcgacagcaactggatgatgttcacaagaaagctaacagtcaagaaaagacaatcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtgaagctgaatggcataaactgttgattgaagaaagagcaaggaaggagatagaagaaaaattaaacgaagccattctcaccttgcagaaacaagcagcagtatctcatgaacagttagcacagttaagggaggataatactacttcaataaaaactcagatggaactcacagtcatagatctggaatctgaaatctccagaataaaaacttcgcaagccgactttaataaaaccaaattggaaagatataaggaactctacctagaagaagtgaaagttagagaatccttgtcaaatgaactcagtagaactaatgagatgatagcagaggtcagtacacaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaaatgcagcagaagttgcaaaatgacctaactgcagaagtagcagctgctactaaatatgaacctggatcctatatagcttctcctctaggatttacacacaaggaaaatctgaatcaagatccagttttggaagtagcaaaagaatatgcacagattttaagaagaaaatacatactctgaaagataaggcaattttatttgggctattcacatgatattttgtttcccattaaatatatgatgtgaacatttttactaaagggaaatattctatgttatacatgtctgatgaaaatttatatagtattttaaataatgtttcttggcctcttcagctaacttttaagtggattttgcaaatgaaaaccagtattactgagttttacatactcgaactgcccaaatgttagctgtttaaacagccaaataatcaagttgccattaataatttagtggagccaattgatggcttgtttgtattttataattttatctttatacatagtgatagatttaagtttagatagacatcattttggtatactggtactgtggtcattgtcaatgtttggatatattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcagaaagttaacatcaatacacttgatcatttcattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaagtttttttatgataagatttagatgataatttttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaataggtgccatggtggtttgctgcacagatcatcccatcacctaggtattaataatagcccagcatccattagctgttcttcacgatgctctcccttctctcacccgccaccatcccacatgcccctgtgtgtgttgttccccgccatgtgtccatgtgttctcattattcagctcccacttgtaagtgagagcatgcagtatttcattttctatttctgcgttggtttgctgaggataatgttctgcagctccacccatgtccctgcaaaggacatgtctcattccttttcatggctgcatagtattccatggtgtatatgtaccacattttctttatccagtttatcattgatgggcttttaggttgattctttgtctttgctattgtgaatagtgctgcaatgaacatacctgtgcgtgtatctttatactagaattagttatattcctttgggtatataccaagtaatgggattgctgggttaaatggtatttcaggttctagatctttgaggaatcaccacactgtcttccacactggttgaactaatttacactcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaggtttttttgtttgttggctgcatgtatgccttcttttgaaaagtgtctgtttgtgtcctttgaccactttctaatggggttgggtttttttttcttgtaaatttgtttaagttccttgtagatgctggatattagacctttgtcagatggatagagtgcaaaaattttctcccattctgtaggttgtcggtttactctgttgatagtttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttctttcaggatttttatagttttgggttgtagatttaagtctttaatccatcttgagttaacttttgtatatgggttaaggaaggggtccagtgtcaatttgctgcatatggctagccagttctcccagcaccatttattaaatagggaatcttttccccattgcttccttttgtcaggtttgtcaaagatcacatggttgtaggtgtgtggtcttatttctgggttctctattctgttccattggtctatgtgtcggttcttgtaccagcaccatgctgttttggttactgtagtcttgtagtatattttgaagctgggtagcatgatgcctctagctttgctcttcttgcttaggattgtcttggctatttgggctctgttttggttccatatgaattttaaaatagctttttctaggtctgtaaagaatgtcaatagtagtttaatgggcctagcatttaatttacagattgccttgggcagtgtggtcattttcatgatattgatccttcctgtctgtgagcatatgtttttccatttgtttgtgtcatctctgatttctttgaataatggtttatagttatccttgaaaaggtccttcacttttcttgttagctgtattcctaggtattatactcttcttgtggcaattgtgaatgggagttaattcatgatttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaagaaagtttgacttcctgtcttcctatttgaatagcttttctttctttctcttgcctgattgccttggtgagaatttctaatactgtgttgaataggagtggtgagagagggcatctttgtcttgtgtcagttttcaagggaatgcttccaggttttcaggtactcaggcaacaaatagcgttacgaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttggcaacacaataatagtgggggatgttaatactccgctggcagcacgaggcagatcaccaagacagaaagtcaacaaagaaacaatggacttaaactataccctagaacaaatggacttaacagatacttacagaacattctacccaacaagcatagaatatacattgtatacatcagaacacgggacattctccaaaatagaccatatgatagggcacaaaacaagtctcagtaaatttaagaaaatcagaattatatcaagtactctctcagaccacagtggaataaaattggaaattaattccaaaaggaacactcaaaagcatgcaaatacatggtaattaaataacctactcctgaatgattgttgggtcaacaatgatatcaagagggaaatttaaaaattctttgaactgaacgataatagtgacacaacctatcaaaaactctgggatacagcaaaagtggagctaagaagaaaattcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatgaaattgaaacaaaaaaatacaacagataaatgaaacaaaaagctggttctttgaaaagataaataaaattgataagcattagcaaga

SEQ ID NO: 27839 - DNA, 5115 bp, Homo sapiens
agaaacataaaaaggatggggtaacagttatagacagcttaggctagtcttggattatagtaatctgcagatacatgttgtgtgaatgacatctgaaggtgttatcttacactgtaaatcatttttatgactacacatacactattccatgaagacgaaaatgcatttctagtgaatttctaaacttgtttgtaaacagtaacttcttttaaattaactctaaatgatctaattaattttcaacttgcataacgtgaaaaagaagtaattttcaacttgtaactttactgaaaaatttcaaatatgcttttccataatatttaccagggttactagtaacagaaacttaccagttaatggaatatttctttcctcactacctctcaaatatatatgtcccttggaagagatcgaagtgagaaattaaaaacatgagaactagaaaggaaacaagagcataggagtttttatgaggataataaacccacatgggaagagccagatcacagaataaacttttttattttttaacaaaacacattttaatgtaatccatgtttaactgcagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcagaagaaaaggaatcctgagatttctcataggcatcagaaagaaaaggatctctttcatgaaaattgcatgttgcaggaagaaattgccttgctgagactggaaatagatacaataaaaaatcagaacaagcaaaaggaaaagaaatattttgaggacattgaggttgtgaaagaaaagaatgataaccttcaaaaaattataaaacgaaatgaggaaacattaacagaaacaatactccagtacagtggacagctgaacaatctgacagctgagaacaaaatgctcaattctgaactggagaatgggaaagagaaccaagaaagactagaaatagaaatggaatcataccgttgtagactggctgctgctgtacatgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaagcaaactgaagaaatacattgccaagcaggaatctgtagaggagagattatctcaactacaaagtgaaaatatgttgcttcgacagcaactggatgatgttcacaagaaagctaacagtcaagaaaagacaatcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtgaagctgaatggcataaactgttgattgaagaaagagcaaggaaggagatagaagaaaaattaaacgaagccattctcaccttgcagaaacaagcagcagtatctcatgaacagttagcacagttaagggaggataatactacttcaataaaaactcagatggaactcacagtcatagatctggaatctgaaatctccagaataaaaacttcgcaagccgactttaataaaaccaaattggaaagatataaggaactctacctagaagaagtgaaagttagagaatccttgtcaaatgaactcagtagaactaatgagatgatagcagaggtcagtacacaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagtttagctatcttttttccttcggcgttcagatttctgatagaattcttgtatgttatttggtaaaatactcagttacttaattgtcttgtgtatggtaagtaaaagtaataattacctgtgttaataaagagaggagacagaaattttacagttattttcaagtctctggagctctcattcataagagattactcctttgttaactttatttaataaatgtaaccaaactgacacattttaaatttttttaaaaactgcatttaagttagattttaaccaaaggtttactttgatgtgctttgtcttactaattgattttagtttgtctggggttcacttttaatgggtttagtgtgcctggggtcacttttaaagtttttctgcatcatctcaggttttctacccgtcatcatatgtgaatgattggtgtccaaacactaaccacccatggatgtttattatttaaaaggacccaaggtgaacacttttatatgttatataaacctgcaacacttgattaatctgttctttaagttaaaagttttgtgattttcttacatgagtacatctgtaattgctattgcacttaatagtgttttaatcccaattttagtaaaatgtgtctgttgctatgcaatagcacagtggttttgaaatagttaaatcaaataaatatttgaatttttaaagtaaagctcacataagttttgtctctctacctggccataactttagtaattgatgactaagatggcaatggtatctagagtccttcaatagcaaatgtgaccaaacagaatcagttctattcttaataccccaaattccatgtaaagctgcacatggacatctcccctggacatgtaacaggaaccttttagttcaaccgtgtggtttcactcagagtaagagtctatttctggggatttcaaaatggatccaaaaatgacgagctgtatcaactatagagttggtaaggaaaaaaaaaaacaaaacgtagttcaactatgcttgacccagattaaggtatttgtctaacatttgtccatttttcaactgagggaaaattacaaaaactgggcacagtggcacacacctgtagtcccagctgctcctgaggctgaggcaggaagatcacttgaacccaggagttcaaatctgcagtgcgcaatgattattcctgtgagtagctacggcactgcagcattccaatctgggtaacatagcaagattctgtctcttaaaaaaattacaaaatccataaaacatttgtttgaacaacaatagataaatagttttctttgtgtatattgttgtttttaaaattttcaatcgatgcacattggcttatagttttgatgtttttatgatctccttagcgcacagaaaagtagcgcaggcccacatggaatgaacctcaaccttgttgtgtttacctggctatttcgtgtcctaacaaatcatagaagagcaaatctaaggtttcttagatagcattgtggccaaatagcttaaaagggaatgcattaaatgattgttttaatacatagattacaagagcccagctagctgatatttttaatcatattgttcgcttaggttttatttttctgaaaaaaatgagatgatcagcgtccaaatgcctcagtcacgaaattgtaccactgggtactaatgggaaatgaatgttaaatacgtctgtaaatggttaagcaagatgcaaatataatgttctcattagtactatgaaccccccaaatttgagacaagtctcaattaatttagaaagtttattttgccgaggttgaggacacacatccgtgacacagcctcaggaagtcctgatgacatgtgtccaaggtggttggggcacaacttggttttatacattttagggagacatgagacatcaatcaatatatttaagaagtacattggttcactctggaaaggcgggacaatttgaagcaaagggaggaagactggtagcggggagggggcttccaggtcacagatagatgagagacaaacagttgcactcttttgagtttctgattagcctttccaaaggagacagtcagatctgcatttatcttagtgagcagagaggtaactttgaatagaatgggaggcaggtttgccctaagcagtttccagcctgagttttccttttagcttagtgattttggaggcccaagatattttcctttcacaatacttaccagaaaaacaaggtaatgtatcattttacaagatggtgctgagagagtataaaaagcagatgtaggccgggcactgtagctcacacgtgtaatcccagcactttgggaggccgaggcgagtgggtcacttgaggtcaggaattcgagaccagcctggacaacatggtgaaaccctgtctctgctaaaaatacaaaaattagcctggcgtggtggcaggcgcctataatcctagctactcgggaggctgaggctggagaatcgcttgaacccaggacgcagaggttgcagtgagccaagattgtgccactgcactgcagcccaggtgacagagcaagactc

SEQ ID NO: 27840 - DNA, 4215 bp, Homo sapiens
cttggcagtggtcgcttggcttggcgtggcagtgatcgcttggcttggcatttctggcttagcggtcctcctttcgcagattggaaaccgcgggctatcctgctgggaggttgtggccgaggcagtagctcgctactgatggtctcctggggtggagaaaagcggggaggggctgaggggtctccgaagccggcagtctacgccacgaggaaaaccggtagcgtcaggagccaggaggaccagtggtacttgggctacccgggggaccagtggtcctcgggcttctcctacagctggtggaaaaacagcgtcggcagcgagagcaagcacggtgagggcgccttagaccagccccagcacgatgtccgcctggaagatcttggcgagctccacagagctgcccggtcgggcgacgtccctggggtggagcacgtcttggttcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggggttgtacttctctcagggaatgatactctccatgacctgtgccaatcacagctaccagaaaacaaagagagcaaagaagcagaacaagacttggagctgacatcagaggaagagcaagaaagacttaaaggatgcgaaaataagcagccacaagttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcggaggattgtgaattgtctcactctgtttatgagaattttatgttgctgattgaacaacttagaatggagtataaagattctgctagcctaccaagaatccaagaaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcagaagaaaaggaatcctgagatttctcataggcatcagaaagaaaaggatctctttcatgaaaattgcatgttgcaggaagaaattgccttgctgagactggaaatagatacaataaaaaatcagaacaagcaaaaggaaaagaaatattttgaggacattgaggttgtgaaagaaaagaatgataaccttcaaaaaattataaaacgaaatgaggaaacattaacagaaacaatactccagtacagtggacagctgaacaatctgacagctgagaacaaaatgctcaattctgaactggagaatgggaaagagaaccaagaaagactagaaatagaaatggaatcataccgttgtagactggctgctgctgtacatgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaagcaaactgaagaaatacattgccaagcaggaatctgtagaggagagattatctcaactacaaagtgaaaatatgttgcttcgacagcaactggatgatgttcacaagaaagctaacagtcaagaaaagacaatcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaagtagttatgagagaattccagcaagaatggaccgatctcctaaaacaacaacctacgtcagaggctacctcacgttgtcacattaatttagatgagacacaggattcaaagaagaaattgggtcaaatcagaagtgaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtgaagctgaatggcataaactgttgattgaagaaagagcaaggaaggagatagaagaaaaattaaacgaagccattctcaccttgcagaaacaagcagcagtatctcatgaacagttagcacagttaagggaggataatactacttcaataaaaactcagatggaactcacagtcatagatctggaatctgaaatctccagaataaaaacttcgcaagccgactttaataaaaccaaattggaaagatataaggaactctacctagaagaagtgaaagttagagaatccttgtcaaatgaactcagtagaactaatgagatgatagcagaggtcagtacacaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagtttagctatcttttttccttcggcgttcagatttctgatagaattcttgtatgttatttggtaaaatactcagttacttaattgtcttgtgtatggtaagtaaaagtaataattacctgtgttaataaagagaggagacagaaattttacagttattttcaagtctctggagctctcattcataagagattactcctttgttaactttatttaataaatgtaaccaaactgacacattttaaatttttttaaaaactgcatttaagttagattttaaccaaaggtttactttgatgtgctttgtcttactaattgattttagtttgtctggggttcacttttaatgggtttagtgtgcctggggtcacttttaaagtttttctgcatcatctcaggttttctacccgtcatcatatgtgaatgattggtgtccaaacactaaccacccatggatgtttattatttaaaaggacccaaggtgaacacttttatatgttatataaacctgcaacacttgattaatctgttctttaagttaaaagttttgtgattttcttacatgagtacatctgtaattgctattgcacttaatagtgttttaatcccaattttagtaaaatgtgtctgttgctatgcaatagcacagtggttttgaaatagttaaatcaaataaatatttgaatttt

SEQ ID NO: 27841 - DNA, 4734 bp, Homo sapiens
atttcctcttaatctgattgcagcttgaaggcagcccatttccattaagtaggactgcatggcaagcagccccaccaaagggttgacaatgagcgtcccagtggctcctaagaaatcatgttacactcagttgcgggacaacagaaatgcagcaagaaataataatgaaagcatcttaagtctgggagatacgaatgccaatcaaatcatgttggaggtcagctcctctcatgacgagtccaagacatgtgacctgggagatgaaattggaaatacaaattcaagtgagccagaaaaccgtacccatttccataaggaatttcaccaacttcagggctttgggaaaggctctcaggctggctctgccagcctgaaagattttagactttcttcaaccattcagagggaactcaatgaagagcacacagtggagagaggcacagatagcctgcagaccacgcggagtattcagggaccaagtctgtcgagttggaggaatgtgatgagtgaggccagtctagacgttttggctaaaagggatgctgaaattccccggcatgttcccaaggataaactggcaaagacccttgacaatgaggaactgaggaggcattctttggaaagagcaagcagctctgtagctgcagtcgggagcctgactccgcagcatccacagcctctatccctcgactcccgggaagcacggggtcagatacctgggggtggggaggggccacagaagacattgccagaccacgctgtcccggcagctttccctgcaactgacagtacctcagagggaaagagtgtgcgtcatcctaaaccatctacctcagaaagcaagcagagcactccctcagagacccaaacagtgggggcacatgtactgcaggtgtgcagtgagcacacatcacattccgcccatccagagcctgctctgaatttgactttggcatcgaaggaaatcccaagtaaactggaagcacaattaggtcagggaaagggagaggccaagctggatctgaaatatgttcctcccaggagagttgaacaggagggaaaggcagcccaggaagggtatctgggatgccacaaggaagagaatctgtcagccttggagggaagggatccatgtggggaagcacacccggaagccaccgatgcacttggccatctgctgaacagtgacctccaccaccttggggtgggaagaggcaactgtgaagagaagagaggagtcaacccaggggagcaggattctctccacaccacccccaaacagggctctgcttccttaggaggggctgataatcagcccactggcaaaatttcaccatgtgcaggtgagaagttgggtgaaaggacatccagcagcttttcaccaggtgacagtcatgtggcttttattcctaataatctgactgacagcaagcccttggatgtcattgaggaggaaaggcggttgggcagtgggaataaggacagtgttatggttttggtgttcaatccttctgttggagagaacaagacggaggtgcctgagcccctggaccctcaaagtggccgctcagaagcacgggaaagcaaagaggtcaccacatctgttgctgaaaacaggaaccttctagagaatgcagataagattgaaagcacctcagcaagagcagattcagttctcaatattccagcacccctccacccagagacaactgtgaacatgacctaccagcctacaacacccagtagcagttttcaggatgttagcgtgttcggtatggatgcggggtcccccttggtagttccaccccctactgatagtgcacgcttgttgaacacgtcccccaaagtgcctgacaagaacacttgccccagtgggatccccaagcctgtcttcacacattccaaggacacaccttcctcgcaggagggaatggagaactatcaggttgaaaaaacagaggagaggacagaaactaagcccatcattatgcccaagcccaagcatgtgaggcccaagatcatcacctacatcaggaggaatccccaggccctgggccaggtggacgcctcgctggttccagtggggcttccatatgccccgcccacatgtaccatgcctcttccccacgaagagaaggcagcaggtggtgacctgaagccatctgccaacctctatgagaaattcaagccagacctgcagaagccaagggtcttcagttccggattgatggtgtctggaatcaagcccccgggacatcctttcagtcaaatgagtgaaaagtttttgcaggaggttacagaccaccctggaaaagaagagttttgttctcctccctatgctcattatgaagtccctccaactttctatcggtcagccatgctccttaagccccagctaggattgggtgcaatgtcccgtttaccatctgcaaagagcaggattctgattgcaagtcagaggtcttcagcgagcgccatccacccaccaggacccataacaacagccaccagtctctacagttccgatccttcagcagatttaaagaaagcttccagttcaaatgctgcaaaatccaatctcccgaaatctggtctccgtcctcccggatactcacgtctcccggcagccaaactggcggcatttggctttgtccggagctccagcgtctcctcagtctccagcacccagtccggggacagtgcacagccagagcagggccggccagccacccgttcaacctttgggaatgaagaacagccagttctgaaggcatctctgccttctaaggacacacccaagggggccggccgggtggcccctccagcatcctccagtgtgacagcaccccgcaggagtttacttccagcgccaaaatccacttccacacccgctggaacaaagaaagatgctccgaaagatcaagatacgaataaacctgctgtttcatctcctaagagagtagcagcttcaaccaccaagcttcattcaccaggatacccaaagcagaggactgcggcagctcgaaatgggtttccgcccaagccggacccgcaggcccgtgaggctgagcggcagctggtgctgcggctgaaggagcggtgtgagcagcagaccagacagctgggcgttgcgcaaggggagctgaagagggccatctgcggctttgatgccctcgccgtggccacgcagcatttctttagaaagaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgatatgtgtgtatatttagatatacgtatatacacatgctgcggttctgaatttcattttttataacatgaagtgctgacatattttagtgaaggtcagcagttttctaacttgtgcctaagaattattgggaaatgaaaatgcatttctatctagcttcccaggaatatttctacccaaaatagaaaaagg

SEQ ID NO: 27842 - DNA, 1779 bp, Homo sapiens
gctgccctgctctcctcctcctctcattcctctgcctcctggattcctgaagtttaggagaaataaggtagccaagggaaccacatggaagttgtgacagctcccagcggcgcgcccctttcgtgtgtgccggtacctcggcttaggagttgcccgctgacaccttgaatgaaggaggtccccttgccagccagcctgccgggatgggccattgctgctgcaagccttataactgccttcagtgcctggacaagacgaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgaagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatat

SEQ ID NO: 27843 - DNA, 8571 bp, Homo sapiens
atgtgtgctccaagcagaagtccagtacctgaaaaggcccctaaagtcctgtggactctcagcaatgagataaatttagattcccagttaagcaacgcaccatggacagtcattaaacggctccgatctccagtaaatggtggaaagaatgaatggattctgtactgtgcctctggggtatgcggggatctgattataactataggtgtagaggctgtgggggaggtagaaattggtatgagaagaaccgtcctttcttccaagcgaaacaagaaggttccagccatctctgctgcaaagggtcttgatgcctacaagacgagtgaggacatcctggaacactatggggatggcagggcaagctctcctatacagccagagcagcagaagctgttctttcccttgcttcttccttccacaacttctgtgagtgcatctaatcggcaggctctaactcacatccaaaactctaaccatgaacatctacaagaagcttctcgtgtgaccaactcttacagccgccaggtgttcacaaacccgcaaggcagagtgggcttgtcctcctttacagagggcgactgcaatgtggcagatccttggggttgtggaggtaaaccccggagcctggaagagcaggtaggatttctacacctagagctagaaggaagcgtgttccagtgcctgaggcagctctggctcggagagccttttgctagccccacggggacctctgtgcacggatggacccgcccggacctggcgggaagcggcctggcaggcggcggccccggcggcatcagcagagacaggacggggccgacgccgcgggcccctgaggcgtgcgtgcccaccgggcccggcggcggcaccatgatgccgggcgagacccattcggcggcgcccgggacggcggcggacctgtcgcgatgtcagggctgcgcctctctgcagcagaatttgaatgaatatgttgaagcattaattaccttgaaacaaaaaattatcaatacagataatttgttaacagaatatcagaagaaatgtgatgagctgcagtttgcaagaagagagaatagtaatctgcatcaccaagtggaagagatgcttcaaaaaatttctcctctacagaaatgtcaggaagaactgggatctttaaaagcagagctagaagagaaaaagagttctttaaagttgtatcaggatactcatcaggaatatgctcgtgtaaaggaagaatgcttgaagagtgatgctcagaagaagaaactagaagctaaggtgaagaagctgcaagaggctgctgtcaagcaaactcaggacttcaagcaactgagaaatgaaaagaaaatacttgaaaaggaatttaagaagacacaggaaaggcttgacgaattttctaaacagaaaaatgaaaaggagttgagacatattggaacacaaatttcaagtgattcatatggaagcatagataaaagaaaagtgaaactgcttctgaaggaactctggctctgtgtaaacacaacacacagactacctggtgaaggcagcaggtgtgtcccagaaaaacctgccaaagcaatcaccagctccagagtgcctggggaagatggtacgctacctccaacacagggcagccctctcaggacctcaaatgtgcagacatgcctcacaaaactgtccatggagataaaggaggactttttatgtcaaaatgtggaaaaacagagctccagtggaacaaattgtagttctgaccatgtttttaatgagaatggaaatcttgaggttttagtacaaagtcatcgtgacggtggtagtactgaatttgttgatcatgatcatttttttgatgaagatcttcaagctgcaattgacttcttcaaacttccccctcctcttctgtcaccagtgccctcgccccctccgatgtcatcacctcacccgggttccttaccgtcttcatttgcacctgaaacctactttggagaatacacagattccagcgataatgactcagtccagcttagaaattctgctgagtgtgtttcagaagatgatacaactgaatcacagaattattttggctcattgagaaaaaataaaggaagtggcacatgggaggaaaagcccaaatcacatgaagctatccaagctctgaatacatgggaagtaaataaagtgacaacttctggactcgagactttcacagcaacactgagagaatcttctgccacacactccttagttggtgaaaaacactggaccacagcatctcgatccatgagtgatagaaaaagagacattttacatgagacaaaaacacaaatggaggttagggagatggataagtcagtacaaactgagaagaccattcataaactcactcgaggtctatgcattgagagattgtctgccagccctgcacaagagaaggaagctgcccctgggaagtctgagttgtgttcttctccccttggcaaaaggccattaaatgaactcatggaatctgaaggaaaaaccgtattgtctaaaatgatgggatcgcccaaatcagagtttactaagtggacacgaattaatgaaatcacttctgaaccagaccgtatcacagtttctggccattttcacagactatctagagaattggaaaaggaaaaagaagatactcaagggttcactttaggagaatcacctgaatcagaagatgatgactcaggtgatggaatggatgtagcagggcttgacattgaaaccagtttttcttcctcttctaccttggtagcattgtctgttggcagtaatccccagtcttcttctgggttagactgtggtaatgatacagatattactactaaagtattctctactgaaccgcatcattcagaacataaattgcaaactaaaactttaaacacattacatctgcagtctgagccaccggagtgttctataggaggaaacaacttggagaatagcttgtgtgccttgagccctgaattgggagcatctaattttaatgatcagaagagcagtgggatagaatatacaaaagtagtaaaaggcttgaccaaaatacattcacttcctcggtcagtatttatgaaagctacaaaagatgggcaatgtgaaagtcaagatccaagaattgagctcacactaaataagccagatttcacatcattaataggttctcaggctgccttgatcaagagtggtttgggttttgttaaaagtacttcatggcaccatagtgatttattaaggaaaggtggcgaagaaagtctgagagccaaatcagaacatgaacagaagactagccatcagttacaaaaggcaatgccattcctacaaaatagaggaccaacacccaagcctgatcttcttagagaaaataacaatcctgtagaattcaagaccactgcatcggtgttgcctaatcaagtatcagttatcacaaaacagacaagacctgaaaaggttcagagtgccaaattggaacacttgaggccacatagggttgagcctaccttagtaacagaaaatagtggcaacaaaaccggtatgtcaactgtagcaaaatgtgatggggaaagagatgatacaacacaaaacatcacggaggtggctgctgtgaaaagcatttcaccagaagtttctgcctctaggagaaaattagattttaattctccaggtggttcttcaccagtagaaaattctgattgttccacaaatagcagattatctttctctcctgaaaatatcctcatccaaaaccaagacattgtgagagaagctgcagtgcagggagatgggcagaagcaaaggcagcctcaggccacagatctggactccagtgggacacatggcagtgagatgcttccagccacagaagtgactgtgtcaggagggttttctgttgaagaaaccagctgtggagacacagggagatctggtggtgaggccctggctgttgcaaatgattctaccagcacaccacaaaatgctaatggactttggaaattgaaatctacaactcccggtggtgctttgcctgagtgttttggcaccacagacactactttttcttcagcattttgcagaaaacatggagagacacaggatacctcccaaagtagcctgcctggtaccttacattgttacacaggcattcgagaggggggagacgacactgaggtagagagtgaggcatttagctgcagtgaggggagcgaacagcaagatgctcctgatgactcacagaaaaatttaggagacacagatgctgctgtagccgaggtgagaccttccttagaggtaggttatttgacgtcagctctgcaagattttaacataagtactttttctgagctggatagactttccacatcagaggttgtgatgtttcttgagagctgtcagttaggggattatagttcaggggactctgtttctgaatgttctagtaaaggaaccctaagtaaagaaatgaacaaagaattaaaggcaagtgaaataggagaaaaatacagaaagcaaccctgtgaggaagaaacacttggaacctgtgaagagtggattgaatcagaggaagatgattattcgttaaaaaatacaagtcagctcactcagtgttctttggaaactctgtctgaggttctgaccaagattaggcaagaacttcaaacaaattctgaagattgcaatggtaaagatactggcagtttattgctcttaaatgtaaataacaacatgaccactgagaatttaaaagagaaaagtccatttcgggaaacgactggctcctcatcacatgcttcagaaccaaccccacaagcagctgccttggacactgagggcagctctcccatcagcggtatgcctcagaatgaaaaccctcagagcagaccagaggcccgttcagatgcaggcaggcaaaccgatggtggggaagaagacctgccagaacctgtggagccatcagccttgtgctctgactctgtgatggagccatccatagagcaaagttctaactgcgaggccgaaacaacatttcagtgtcagatagcaacagtgacctcagaagttataaacgtacttataaataaggatcagaatctagtcattgaaaagggggacaactggacaatcatcagtggtgtagctgtcttgccacatgtggaccaggtcacactgtgtgacattcctggagacatccctatttctcaggatcaaggagagctggaagctggttgcatcccagtgacttctgctgagaagtccccagaggccagtcacactggccctgcatttcaggaggctccatgtggcaataatctttcatgtccccaagaggatgtttcaagcagtggtcagagcaccaactttgataagagtcgtttgcgaaatagacccgttaagcctagtatatggattagttctcaaatctatgatcaaaacttcgagactcagattgttgcgtctgatcacacatattataactcaaaactagagccatctggcaaaaataagaatcgatcaaagatttcaaacaaagatcagtcaaacaaaccagtaaaaacttcagcgtcgagcagagttgaaactcatcagagtgaagttgctcagtcattttcaggggaaaaagctaatacaaaaactcaaagaagccaaactcagaccattttagcaaatgctgatacatccactcctacagattgttctcctgacacactgagtaaaatacggcaagaggtggggcctcctttgccgcctctgcttgctcctctgatagctacacctccaaggacttcacagccactgtctccactgatatcgagttctagtccttcctcaccagcctctcctgttggccaggtttctcccttccgtgaaaccccagtgcctcctgccatgtctccatggccagaggaccccagacgtgcctctcctccagatccttctccatctccatctgcagcttcagccagtgagagggtagtgccgtctcctctgcagttctgtgcggccacgccgaagcacgcacttcctgtgcctggccgactcccaccctgtgcatctggccacgctgctgtgggagggcctcaggagaattctgtgaaaatccttgacaccatgtatccagagttatctgccagggcccggaccctcaacatcctcaaagggaatattcaactcacacgaggtccgcctgctgactgtaagaatttaccgggacctgccagtgctatgataggattcaaaacgatcacttcagcagcaactgcttttgtcaaaactgggagcagctctggtggtgactgtaaccaagacaagtcaagagatttggggactcagcaggattcaagcgggaaaagaacactgtcaacgtctacactgagaagtgctaaaagactgcgcctggacactgggtccccagaaccagaaaccaggggagtcactgcagaaggaatccacaaaaacctcccagggaacctccctccagctgaagttgcaacaacaaatgaggaaagaagttgttctagtccagccgtcagtgcagtttcacagttgcctttaagcccaaaagaaactgtggagtcccatgataaagccatagctaatgccctgaagaaaattgcagagttttcttttgatctgttacctgtcattcgtagtcatgtgtatgtgggaaatatctccaaaaagcccgtaatgagagatcaagagaaggaagttgtttatgaatttagcacaacaaaaaagcatttagcagagtgcttgcttcactctattctctcagaactaaaaattcagaagatatctatggaccacaattacattcacgccctctgcagggtgtatgtgggtatttgtcggcaactcggagacttggaaagagctcgtttgttttgctacagcctacttaaagaagattttccggagtctgaaaaattaactttgtttattgcaaacatgtggcatgatatatttctctctcaatcggtgattaataaagcaatgcagttagttgccaggcaacgtgctaaaggagaggttctgaactgcttgagagcttttcttaattgggaaaagaatgccccggtagatgttggcttcatggtttctaagctgcttttgaccatacagttatgtccaaaaacagaatttcaacctagtgaaaaatttggtgaagacctaagtgataacacttgggaatacatatttgccattgatctgctctgctgccatcagaaatggatctggacgcatgataacatcataagtaaggagctgtggcctgtgatggataaatggataaaatacagaaaaggacatgcaaacattgcgtatactcctgatattattatagcctcaatactgaggctgattggtcgtttaggccaattgggtttgaaagaaggatttccatctgctgtgaaaaatattagttcggttattggtatgtttatacagcatgctcacgatgaagatataccatggggtatacagttagcagccgtgtatgctctttgtgacttgagtcccagcaatccagcagaaatttccaagatcctggaagcttggcggagagaggcctccaaaagcgttccgtctgcgattgtcagctgcctagaggaagtcagtgccctgagcacagaggagcttggctgacctgggatgccactgaggcttgagaagtgccttgacacattttgaacacaaatagtttgatcagctttcagaatacaaagggaggtttcaaaacaaaaagacataaaatagataaaacagaccagaggctctccttattgtttggcaaggagacaggagaaacaagcagtcgcatagtcgtttttccctaaatctaatacgtttcacttaaggctgttgtgatctgtgacatatgggttatattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagcccttagcagaaacccactttaatgcattttcttcatatccctaaagttccttaaaaatatgtgacaatgcatcaggaagaggagaactgaagagtagaagttcccttgcagatttttttatcagtgacatgtaatgagcaattcacagatgagcgcaggcagagctctgtgtgccgtgtacatatggaccgtgctatgatgtgtctcacattggatgatattccactttgggaattttagtatttgtatatagaaaatgggtttaataactcaccatggttttgatttgtcttatattcgttatttcttaaaactcttgtatgtgtttttataataaaaaataaaagtaagccatggatattactgtt

SEQ ID NO: 27844 - DNA, 8880 bp, Homo sapiens
atgtgtgctccaagcagaagtccagtacctgaaaaggcccctaaagtcctgtggactctcagcaatgagataaatttagattcccagttaagcaacgcaccatggacagtcattaaacggctccgatctccagtaaatggtggaaagaatgaatggattctgtactgtgcctctggggtatgcggggatctgattataactataggtgtagaggctgtgggggaggtagaaattggtatgagaagaaccgtcctttcttccaagcgaaacaagaaggttccagccatctctgctgcaaagggtcttgatgcctacaagacgagtgaggacatcctggaacactatggggatggcagggcaagctcccctatacagccagagcagcagaagctggtctttcccttgcttcttccttccacaacttctgtgagtgcatctaatcggcaggctctaactcacatccaaaactctaaccatgaacatcaagtgggagaacaggggcacatgcaggcatcgtgctgcagggagatgctcctcgcaggacccaggacagaaccggctgccagggatggcagcgaccatgatggctgtgagttaggtgggacatgcccttgccagctgctctacagagaatcccctcctcaacacctgtcacctctgagcacctgccgccttcttcctccgatcccggaagctacaagaagcttctcgtgtgaccaactcttacagccgccaggtgttcacaaacccgcaaggcagagtgggcttgtcctcctttacagagggcgactgcaattgtcaaaaacaggatttggaggtggcaggataatggccaaaatgggtagacaaggtggcgaacgattcaaccaggctctgggcttggcgcatggtgggcggtggcgcccacacctgggcctgggaacccgccgctcgggcatcactggctgccgcggcgaccggcgaggacacatgaccgaggagcgaaagtgcctgaggcagctctggctcggagagccttttgctagccccacggggacctctgtgcacggatggacccgcccggacctggcgggaagcggcctggcaggcggcggccccggcggcatcagcagagacaggacggggccgacgccgcgggcccctgaggcgtgcgtgcccaccgggcccggcggcggcaccatgatgccgggcgagacccattcggcggcgcccgggacggcggcggacctgtcgcgatgtcagggctgcgcctctctgcagcagaatttgaatgaatatgttgaagcattaattaccttgaaacaaaaaattatcaatacagataatttgttaacagaatatcagaagaaatgtgatgagctgcagtttgcaagaagagagaatagtaatctgcatcaccaagtggaagagatgcttcaaaaaatttctcctctacagaaatgtcaggaagaactgggatctttaaaagcagagctagaagagaaaaagagttctttaaagttgtatcaggatactcatcaggaatatgctcgtgtaaaggaagaatgcttgaagagtgatgctcagaagaagaaactagaagctaaggtgaagaagctgcaagaggctgctgtcaagcaaactcaggacttcaagcaactgagaaatgaaaagaaaatacttgaaaaggaatttaagaagacacaggaaaggcttgacgaattttctaaacagaaaaatgaaaaggagttgagacatattggaacacaaatttcaagtgattcatatggaagcatagataaaagaaaagtgaaactgcttctgaaggaactctggctctgtgtaaacacaacacacagactacctggtgaaggcagcaggtgtgtcccagaaaaacctgccaaagcaatcaccagctccagagtgcctggggaagatggtacgctacctccaacacagggcagccctctcaggacctcaaatgtgcagacatgcctcacaaaactgtccatggagataaaggaggactttttatgtcaaaatgtggaaaaacagagctccagtggaacaaattgtagttctgaccatgtttttaatgagaatggaaatcttgaggttttagtacaaagtcatcgtgacggtggtagtactgaatttgttgatcatgatcatttttttgatgaagatcttcaagctgcaattgacttcttcaaacttccccctcctcttctgtcaccagtgccctcgccccctccgatgtcatcacctcacccgggttccttaccgtcttcatttgcacctgaaacctactttggagaatatacagattccagcgataatgactcagtccagcttagaaattctgctgagtctgtttcagaagatgatacaactgaatcacagaattattttggctcattgagaaaaaataaaggaagtggcacatgggaggaaaagcccaaatcacatgaagctatccaagctctgaatacatgggaagtaaataaagtgacaacttctggactcgagactttcacagcaacactgagagaatcttctgccacacactccttagttggtgaaaaacactggaccacagcatctcgatccatgagtgatagaaaaagagacattttacatgagacaaaaacacaaatggaggttagggagatggataagtcagtacaaactgagaagaccattcataaactcactcgaggtctatgcattgagagattgtctgccagccctgcacaagagaaggaagctgcccctgggaagtctgagttgtgttcttctccccttggcaaaaggccattaaatgaactcatggaatctgaaggaaaaaccgtattgtctaaaatgatgggatcgcccaaatcagagtttactaagtggacacgaattaatgaaatcacttctgaaccagaccgtatcacagtttctggccattttcacagactatctagagaattggaaaaggaaaaagaagatactcaagggttcactttaggagaatcacctgaatcagaagatgatgactcaggtgatggaatggatgtagcagggcttgacattgaaaccagtttttcttcctcttctaccttggtagcattgtctgttggcagtaatccccagtcttcttctgggttagactgtggtaatgatacagatattactactaaagtattctctactgaaccgcatcattcagaacataaattgcaaactaaaactttaaacacattacatctgcagtctgagccaccggagtgttctataggaggaaacaacttggagaatagcttgtgtgccttgagccctgaattgggagcatctaattttaatgatcagaagagcagtgggatagaatatacaaaagtagtaaaaggcttgaccaaaatacattcacttcctcggtcagtatttatgaaagctacaaaagatgggcaatgtgaaagtcaagatccaagaattgagctcacactaaataagccagatttcacatcattaataggttctcaggctgccttgatcaagagtggtttgggttttgttaaaagtacttcatggcaccatagtgatttattaaggaaaggtggcgaagaaagtctgagagccaaatcagaacatgaacagaagactagccatcagttacaaaaggcaatgccattcctacaaaatagaggaccaacacccaagcctgatcttcttagagaaaataacaatcctgtagaattcaagaccactgcatcggtgttgcctaatcaagtatcagttatcacaaaacagacaagacctgaaaaggttcagagtgccaaattggaacacttgaggccacatagggttgagcctaccttagtaacagaaaatagtggcaacaaaaccggtatgtcaactatagcaaaatgtgatggggaaagagatgatacaacacaaaacatcacggaggtggctgctgtgaaaagcatttcaccagaagtttctgcctctaggagaaaattagattttaattctccaggtggttcttcaccagtagaaaattctgattgttccacaaatagcagattatctttctctcctgaaaatatcctcatccaaaaccaagacattgtgagagaagctgcagtgcagggagatgggcagaagcaaaggcagcctcaggccacagatctggactccagtgggacacatggcagtgagatgcttccagccacagaagtgactgtgtcaggagggttttctgttgaagaaaccagctgtggagacacagggagatctggtggtgaggccctggctgttgcaaatgattctaccagcacaccacaaaatgctaatggactttggaaattgaaatctacaactcccggtggtgctttgcctgagtgttttggcaccacagacactactttttcttcagcattttgcagaaaacatggagagacacaggatacctcccaaagtagcctgcctggtaccttacattgttacacaggcattcgagaggggggagacgacactgaggtagagagtgaggcatttagctgcagtgaggggagcgaacagcaagatgctcctgatgactcacagaaaaatttaggagacacagatgctgctgtagccgaggtgagaccttccttagaggtaggttatttgacgtcagctctgcaagattttaacataagtactttttctgagctggatagactttccacatcagaggttgtgatgtttcttgagagctgtcagttaggggattatagttcaggggactctgtttctgaatgttctagtaaaggaaccctaagtaaagaaatgaacaaagaattaaaggcaagtgaaataggagaaaaatacagaaagcaaccctgtgaggaagaaacacttggaacctgtgaagagtggattgaatcagaggaagatgattattcgttaaaaaatacaagtcagctcactcagtgttctttggaaactctgtctgaggttctgaccaagattaggcaagaacttcaaacaaattctgaagattgcaatggtaaagatactggcagtttattgctcttaaatgtaaataacaacatgaccactgagaatttaaaagagaaaagtccatttcgggaaacgactggctcctcatcacatgcttcagaaccaaccccacaagcagctgccttggacactgagggcagctctcccatcagcggtatgcctcagaatgaaaaccctcagagcagaccagaggcccgttcagatgcaggcaggcaaaccgatggtggggaagaagacctgccagaacctgtggagccatcagccttgtgctctgactctgtgatggagccatccatagagcaaagttctaactgcgaggccgaaacaacatttcagtgtcagatagcaacagtgacctcagaagttataaacgtacttataaataaggatcagaatctagtcattgaaaagggggacaactggacaatcatcagtggtgtagctgtcttgccacatgtggaccaggtcacactgtgtgacattcctggagacatccctatttctcaggatcaaggagagctggaagctggttgcatcccagtgacttctgctgagaagtccccagaggccagtcacactggccctgcatttcaggaggctccatgtggcaataatctttcatgtccccaagaggatgtttcaagcagtggtcagagcaccaactttgataagagtcgtttgcgaaatagacccgttaagcctagtatatggattagttctcaaatctatgatcaaaacttcgagactcagattgttgcgtctgatcacacatattataactcaaaactagagccatctggcaaaaataagaatcgatcaaagatttcaaacaaagatcagtcaaacaaaccagtaaaaacttcagcgtcgagcagagttgaaactcatcagagtgaagttgctcagtcattttcaggggaaaaagctaatacaaaaactcaaagaagccaaactcagaccattttagcaaatgctgatacatccactcctacagattgttctcctgacacactgagtaaaatacggcaagaggtggggcctcctttgccgcctctgcttgctcctctgatagctacacctccaaggacttcacagccactgtctccactgatatcgagttctagtccttcctcaccagcctctcctgttggccaggtttctcccttccgtgaaaccccagtgcctcctgccatgtctccatggccagaggaccccagacgtgcctctcctccagatccttctccatctccatctgcagcttcagccagtgagagggtagtgccgtctcctctgcagttctgtgcggccacgccgaagcacgcacttcctgtgcctggccgactcccaccctgtgcatctggccacgctgctgtgggagggcctcaggagaattctgtgaaaatccttgacaccatgtatccagagttatctgccagggcccggaccctcaacatcctcaaagggaatattcaactcacacgaggtccgcctgctgactgtaagaatttaccgggacctgccagtgctatgataggattcaaaacgatcacttcagcagcaactgcttttgtcaaaactgggagcagctctggtggtgactgtaaccaagacaagtcaagagatttggggactcagcaggattcaagcgggaaaagaacactgtcaacgtctacactgagaagtgctaaaagactgcgcctggacactgggtccccagaaccagaaaccaggggagtcactgcagaaggaatccacaaaaacctcccagggaacctccctccagctgaagttgcaacaacaaatgaggaaagaagttgttctagtccagccgtcagtgcagtttcacagttgcctttaagcccaaaagaaactgtggagtcccatgataaagccatagctaatgccctgaagaaaattgcagagttttcttttgatctgttacctgtcattcgtagtcatgtgtatgtgggaaatatctccaaaaagcccgtaatgagagatcaagagaaggaagttgtttatgaatttagcacaacaaaaaagcatttagcagagtgcttgcttcactctattctctcagaactaaaaattcagaagatatctatggaccacaattacattcacgccctctgcagggtgtatgtgggtatttgtcggcaactcggagacttggaaagagctcgtttgttttgctacagcctacttaaagaagattttccggagtctgaaaaattaactttgtttattgcaaacatgtggcatgatatatttctctctcaatcggtgattaataaagcaatgcagttagttgccaggcaacgtgctaaaggagaggttctgaactgcttgagagcttttcttaattgggaaaagaatgccccggtagatgttggcttcatggtttctaagctgcttttgaccatacagttatgtccaaaaacagaatttcaacctagtgaaaaatttggtgaagacctaagtgataacacttgggaatacatatttgccattgatctgctctgctgccatcagaaatggatctggacgcatgataacatcataagtaaggagctgtggcctgtgatggataaatggataaaatacagaaaaggacatgcaaacattgcgtatactcctgatattattatagcctcaatactgaggctgattggtcgtttaggccaattgggtttgaaagaaggatttccatctgctgtgaaaaatattagttcggttattggtatgtttatacagcatgctcacgatgaagatataccatggggtatacagttagcagccgtgtatgctctttgtgacttgagtcccagcaatccagcagaaatttccaagatcctggaagcttggcggagagaggcctccaaaagcgttccgtctgcgattgtcagctgcctagaggaagtcagtgccctgagcacagaggagcttggctgacctgggatgccactgaggcttgagaagtgccttgacacattttgaacacaaatagtttgatcagctttcagaatacaaagggaggtttcaaaacaaaaagacataaaatagataaaacagaccagaggctctccttattgtttggcaaggagacaggagaaacaagcagtcgcatagtcgtttttccctaaatctaatacgtttcacttaaggctgttgtgatctgtgacatatgggttatattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagcccttagcagaaacccactttaatgcattttcttcatatccctaaagttccttaaaaatatgtgacaatgcatcaggaagaggagaactgaagagtagaagttcccttgcagatttttttatcagtgacatgtaatgagcaattcacagatgagcgcaggcagagctctgtgtgccgtgtacatatggaccgtgctatgatgtgtctcacattggatgatattccactttgggaattttagtatttgtatatagaaaatgggtttaataactcaccatggttttgatttgtcttatattcgttatttcttaaaactcttgtatgtgtttttataataaaaaataaaagtaagccatggatattactgtt

SEQ ID NO: 27845 - DNA, 6186 bp, Homo sapiens
atgaagacagatgaggacaaagaggagggaaaaaagaggttaaattgggatacagatacactgtggaagctgcagccctactgtcggccgctggcgcagtccccgcgccgcagtgccgggcgctcgtggggggcgcccacgggcacctgggccgtctgctcatcggagccgtccgccgtcctcccgcattcccacggcgccccacgcccgcgcgcccgtcgccggtcacccgccgcccgcggagccgcgagggcgtctcctggaggcgcaagaggactgggcggggcggggcgcgcccaccggccggcccagggcacctcgcgcgggtgcacacgccgcagccccccggggcgggtgggtgtgctccggccgcgcgcgccgccgccgccgccgccgccgccgccgcctcctcagcctgccgctccgcccgcgccgcctgctgccggcgctcggcccagcacgccggctctcgggctgccgtgggctgcgcggggcccgcggtgtgtagagtccgccgccccggagccgcgtcccgcacccggacggtcccgagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttcttttttttttttttttaattttccttatttcaagctcttatctgaaaaaatgctactttctcctaccacttagtttgaatttgcccaggatatctgtctgggcccctggctgcaacccagacaatggcgagatctcctggagtgggggatattcacgcatcgtgcctgttcctgacagctcagccctggtgtagggtgggactgggcattttctctgctgttacttttctgctaccactatttttggcaaccttggaaagaaaataaacaggttacagaatttcggctagcactaagggaaagctttttcctctgggccacatgccccagtgacccagagcatggaaagggggtcagctctggtctgggccagtgactaagaagcccaatcacattccagtttctatagcactgggtaggcacaacccacagttaagaacatcaagttataagtagccaggccttttcatagccatggtgacacaaaggccctcaagattagcctcctgccatcatgggttggcctgtgatctgtcccccagccaaacccaagtttgtgagagggactctgagaacacttgagcaacacttgggaatccaatgcgctctggtccctcatgcccttcccatgtgcttttctgcagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcga

SEQ ID NO: 27846 - DNA, 6210 bp, Homo sapiens
atgaagacagatgaggacaaagaggagggaaaaaagaggttaaattgggatacagatacactgtggaagctgcagccctactgtcggccgctggcgcagtccccgcgccgcagtgccgggcgctcgtggggggcgcccacgggcacctgggccgtctgctcatcggagccgtccgccgtcctcccgcattcccacggcgccccacgcccgcgcgcccgtcgccggtcacccgccgcccgcggagccgcgagggcgtctcctggaggcgcaagaggactgggcggggcggggcgcgcccaccggccggcccagggcacctcgcgcgggtgcacacgccgcagccccccggggcgggtgggtgtgctccggccgcgcgcgccgccgccgccgccgccgccgccgccgcctcctcagcctgccgctccgcccgcgccgcctgctgccggcgctcggcccagcacgccggctctcgggctgccgtgggctgcgcggggcccgcggtgtgtagagtccgccgccccggagccgcgtcccgcacccggacggtcccgagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcaaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttcttttttttttttttttaattttccttatttcaagctcttatctgaaaaaatgctactttctcctaccacttagtttgaatttgcccaggatatctgtctgggcccctggctgcaacccagacaatggcgagatctcctggagtgggggatattcacgcatcgtgcctgttcctgacagctcagccctggtgtagggtgggactgggcattttctctgctgttacttttctgctaccactatttttggcaaccttggaaagaaaataaacaggttacagaatttcggctagcactaagggaaagctttttcctctgggccacatgccccagtgacccagagcatggaaagggggtcagctctggtctgggccagtgactaagaagcccaatcacattccagtttctatagcactgggtaggcacaacccacagttaagaacatcaagttataagtagccaggcctttccatagccatggtgacacaaaggccctcaagattagcctcctgccatcatgggttggcctgtgatctgtcccccagccaaacccaagtttgtgagagggactctgagaacacttgagtaacacttgggaatccaatgcgctctggtccctcatgcccttcccatgtgcttttctgcagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctctaaaaacaaaacaacaaccaca

SEQ ID NO: 27847 - DNA, 7676 bp, Homo sapiens
gccgcggacgcgatgctggttgctgcggctcgggcggcggggctggcggggatgtgacgggcggcccttcgtctcaccttccgtcctcgggcccgcaggtcgcagggcggcctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctggtgggtattctgctccctccttctctccttggcagggctccttccaggggatcccacggactgttccaccgcaccgcagacagacctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccacgtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaagtgtttcttattacatataaatcagttatatattcctttacatcttgttttacaaacacatgtgcatgcacacacacatatacacacacataccatttatgtttgtatttgttactgggtaaattttggagcgcttgagatacaccttgaaacctgtacctaaagatgtattcatttgtaacatatgttggtgctagagttttgctggtaattcaggcttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgagatttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttatcgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaaagtt

SEQ ID NO: 27848 - DNA, 2138 bp, Homo sapiens
atactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattgtaattaaatttcaagtgggagacttaactttagaactcacttccagcttgcactttgctttaatttctctgagctgcaagaatgtcttagcgagccttgcttgcagttgtcacacacactgtccggtttttttcaggataaatgaatgattctgccttttgttatgtgcgtgaacagaatggaacaactcaagtagcttcatcttcagagactgaatttattctgatagacttcagctaattacaaaggattttgctaatttttgggaataaataatggaaaaagatccagtctgtggtatcatgctagtgctgacagggccttgatagaatagagttggaaaagatggtaagcttttgtcagggttttaacattttcttgatgaaacaataaaaagaggtaagcttttttcttctttttttttaagttttaaataaactcagatataatttgaatactgaagaaattaagagactttgaacaaaatctcttcccaaatctaaatttgataggggaggtggagattccaggggtgggtgaaagaagagatagaacttagcaggcagacttaaaaaaaaaaaaaaaaaaaaaaaaaaaaaaaaa

SEQ ID NO: 27849 - DNA, 5614 bp, Homo sapiens
atggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcgacagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagcggagaacaagcagctgcggcgtgcaggctgcccctaccaggcagacgagaaggtgaagcggctcaaggtaaagcgcgcggagctgaccgggctcgcgcggcgcctagctgaccgcgcccgcaagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcgcgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgaggatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggagtggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggcgcgggtggaggtgcggctgccacgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccctattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctcccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgtggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggaacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctccctcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgt

SEQ ID NO: 27850 - DNA, 5765 bp, Homo sapiens
atgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagctgtaaactcatctcttttccctttattcaagctgtcaatttttgtctcctaaacatcttctagttatattctcatttctctgttcacattgcattaataatgatgataaacatttgcattcttattctgtgccaggcaacatgctaactgctgtatatatattattacatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatttggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctc

SEQ ID NO: 27851 - DNA, 4031 bp, Homo sapiens
cctcagtcctcccttggtggcctcgccgcggctctgctgggagacccggcgctggcggctgctgaggccggagcggagggcccgggagcgtgggagcaggagggtggcgcgcagccggtttcgcgtttggtcggccagggagctgccttcccaccagccggtcgaggaaacaacgggtcgggcttccggggagagggcccacacagtctcctcgccggcaccggcctcctccatttttccgggccttgcgtggagggttttggcggatgtttttgaacgaaggaatgtcatcggggctctctcgagcccctcaccccgccagctactctgggggtggcgtggcatagtgagaggagcgctaagttgttgggaggcctgggtccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggttttttttttttttttttggcttgttttttaaataaaccaaagtcaaaaacaaaaaaaaaaaaaaaaaaaaaaaaaaaaaaaaaaaaaaaaaaaaaaaaaaaaaa

SEQ ID NO: 27852 - DNA, 3749 bp, Homo sapiens
gtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggttttttttttttttttttggcttgttttttaaataaaccaaagtcaaaaacaaaaaaaaaaaaaaaaaaaaaaaaaaaaaaaaaaaaaaaaaaaaaaaaaaaaaa

SEQ ID NO: 27853 - DNA, 4908 bp, Homo sapiens
acctgcgtgcagtcggtcctccaggccacgcagcgcccgagagtaccagggagactccggcccctgtcggcgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcagaccatttaatttggcagagcggaaagctagcgcccattcaatagtagaatgtgatcctgtacgaaaagaagttagtgtacgaactggaggattggctgacaagagctcaaggaaaacatacacttttgatatggtgtttggagcatctactaaacagattgatgtttaccgaagtgttgtttgtccaattctggatgaagttattatgggctataattgcactatctttgcgtatggccaaactggcactggaaaaacttttacaatggaaggtgaaaggtcacctaatgaagagtatacctgggaagaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaagagaggagtgataattaaaggtttagaagaaattacagtacacaacaaggatgaagtctatcaaattttagaaaagggggcagcaaaaaggacaactgcagctactctgatgaatgcatactctagtcgttcccactcagttttctctgttacaatacatatgaaagaaactacgattgatggagaagagcttgttaaaatcggaaagttgaacttggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggaaactctgagtacattggaatatgctcatagagcaaagaacatattgaataagcctgaagtgaatcagaaactcaccaaaaaagctcttattaaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttaacataggtaaatatcaccaacatctgtccttagaaaggaccatctcatgttttttttcttgctatgacttgtgtattttcttgcatcctccctagacttccctatttcgctttctcctcggctcactttctccctttttatttttcaccaaaccatttgtagagctacaaaacctatcctttcttattttcagtagtcagaattttatctagaaatcttttaacacctttttagtggttatttctaaaatcactgtcaacaataaatctaaccctagttgtatccctcctttaagtatttaaaacttgttgccccaaatgtgaaagcatttaattcctttaagaggcctaactcattcaccctgacagagttcacaaaaagcccactttagagtatacattgctattatgggagaccacccagacatctgactaatggctctgtgccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacatt

SEQ ID NO: 27854 - DNA, 4775 bp, Homo sapiens
cagtcgcgcgcggtgcagtcgggaggtggaggcaccggctgcattgttttcgggatcgaggggtgagggcgctatggcacccggctgcaaaactgagttacgcagcgtgacaaatggtcagtctaaccaaccaagtaatgaaggtgatgccatcaaagtttttgtgcgaattcgtcctcctgcagaaagatctgggtcagctgatggagagcagaacttatgcttatctgtgctgtcctccacgagtctccggctgcactccaaccctgagcccaagaccttcacgtttgatcatgttgcagatgtggataccactcaggaatctgtatttgcaactgtggctaaaagcattgtggagtcttgcatgagcggttataatggtaccatctttgcatatggacagactggctcagggaagacatttactatgatgggaccatctgaatctgataatttttctcataacctgagaggagtaatcccacgaagttttgaatatttgttttccttaattgatcgtgaaaaagaaaaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtgctgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttctgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttacttgagcattttccatgactgtaaataaagccattttttaagataaaaaaaaaaaaaaaaaa

SEQ ID NO: 27855 - DNA, 2334 bp, Homo sapiens
ggcgcgctaggctcacaaaggcaggcacagactgcaaccctgctcagtgctccgggcgcttcaggctggcttgggtcctgctgctccaaccccaagggccctggagcgctccctgatacctccatcactcaccatggccagccagttctgcctccctgaatccccatgtctctcgcccctgaaacccttgaagccacatttcggagacatccaagagggcatctacgtggcgatccagcgcagtgacaagcggatccacctcgctgtggtcacggagatcaacagagaaaactattgggtcacggtagagtgggtggagaaagcagtcaaaaaaggcaagaagattgacctggagaccatactcctgctgaatccagctctggactctgctgaacaccccatgccgcccccgcccttatcccccttggctctggcgccctcttcggccatcagggaccagcgtaccgccacgaaatgggttgcgatgatcccccagaaaaaccaaacagcctcaggggacagcctggatgtgagggtccccagcaaaccttgtctgatgaagcagaaaaagtctccctgcctctgggaaatccagaaactgcaggagcagcgggaaaagcgcaggcggctgcagcaggagatccgagctagacgcgccctcgatgtcaataccagaaaccccaactacgaaatcatgcacatgatcgaagagtatcgcaggcacctggacagcagcaagatctcagtcctggagcccccgcaagaacatcgcatctgcgtctgcgtgaggaagcggcctctcaaccagcgagagacaaccttgaaggacctggatatcatcaccgtcccctcggacaatgtggttatggtgcatgagtccaagcaaaaggtggacctcactcgctacctgcagaaccagaccttctgcttcgaccatgccttcgatgacaaagcctccaacgagttggtgtaccagttcaccgcccagccactggtggagtccatcttccgcaagggcatggccacctgctttgcctatgggcagacgggaagtgggaagacgtacaccatgggtggagacttttcaggaacggcccaagattgttctaagggcatttatgctctggtggcacaggatgtctttctcctgctcagaaactccacatatgagaagctggacctcaaagtctatgggacattttttgagatttatgggggcaaggtgtatgatttgttgaactggaagaagaagctgcaagtccttgaggatggcaatcagcaaatccaagtggtcgggctgcaggagaaagaggtgtgttgtgtggaggaagtgctgaacctggtggaaatagggaatagctgtcggacttccaggcaaacatctgtcaacgctcactcatccaggagccatgcagtgttccagatcatcctgaagtcaggagggataatgcatggcaagttttccctcgttgatttagctgggaatgaaagaggagcagatacaaccaaggccagccggaaaaggcagctggaaggggcagagattaacaagagtcttctagccctcaaagaatgtattctggctttgggtcagaacaagcctcacaccccattcagagccagcaaactcacactggtgctccgggactcctttataggccagaactcctccacttgcatgattgctaccatctctccggggatgacctcttgtgaaaacactctcaacactttaagatatgcaaacagagtaaaaaaattaaatgtagatgtaaggccctaccatcgtggccactatccgattggacatgaggcaccaaggatgttaaaaagtcacatcggaaattcagaaatgtcccttcagagggatgaatttattaaaataccttatgtacagagtgaggagcagaaagagattgaagaggttgaaacattacccactctgttagggaaggataccacaatttcagggaagggatctagccaatggctggaaaacatccaggagagagctggtggagtacaccatgatattgatttttgcattgcccggtctttgtccattttggagcagaaaattgatgctctgaccgagatccaaaagaaactgaaattattactagctgacctccacgtgaagagcaaggtagagtgaagccaatggcgagagatcaggtccgaaatgctgcattgctgcagtttccaccactcttatacaggaaaactgtccaaattatctaaagatcctcctgagaagcttaaaacatcttaaaatacactgatgggaaacatgctctttcttctgcctctgttaaaaaaaaaaaaaaaaaaaaa

SEQ ID NO: 27856 - DNA, 2825 bp, Homo sapiens
gcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgtggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgctcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcagacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttacgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagtcctagaggatccctactgttttctgttttatgtgtttatacattgtatgtaacaataaagagaaaaaataaaaaaaaaaaaaaaaaaaaaaaaaaaaaaaa

SEQ ID NO: 27857 - DNA, 2391 bp, Homo sapiens
tcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccacctcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaaaaaaaaaaaaaaaaaaaaaaaaaaaaa

SEQ ID NO: 27858 - DNA, 1808 bp, Homo sapiens
tccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacaccaaa

SEQ ID NO: 27859 - DNA, 2326 bp, Homo sapiens
gtcaagatggcggctgcggcagtggcggcggcggcggcggcggccgcggctgcatctcttcaggtactggagatggagagcatggagacggccgccgccggctcggcaggactggccgccgaggtccgaggcagcggcacggtggacttcgggcctgggccggggatctctgcaatggaggcgagcgggggcgatccgggcccagaagccgaggatttcgagtgcagctctcactgctcagagctgtcctggcggcagaacgagcagcggcgccagggcctcttctgcgacattaccctgtgcttcggcggggctggaggccgcgagttccgggcccaccgctcggtactggctgccgccaccgagtacttcacgcccctgctctcgggccagttttccgagtcccgctcgggacgggtggagatgcgcaagtggagctccgagccggggcccgaacccgacacagtggaagccgtaatcgagtacatgtacaccgggcgcatccgcgtcagcacgggcagcgtgcacgaggtgctggagttggccgacaggttcctactcattcgtttaaaagaattttgtggagaatttctcaagaaaaaacttcatctctcaaattgtgtggcaattcatagcttagcacacatgtacaccctgagccaacttgctctgaaggctgctgatatgatacggagaaatttccacaaagtgattcaggatgaagaattttatacgttacctttccatctcattagagactggctttcagatttggaaattacagttgattctgaagaggttctctttgaaaccgttttgaaatgggttcagagaaatgctgaagagagagagagatactttgaagaactttttaaattgctcaggttgtcccagatgaaacctacctaccttactcgacatgtcaaaccagagaggctggtagccaataatgaagtttgtgtcaagttggtcgctgacgcagtggagagacatgctctgagagctgagaatatacaatctggcacatgccagcaccccacttctcatgtgtcactattgcctcgttatgggcaaaacatggatgtgatcatggttattggaggtgtgtcagaaggaggggactatttaagtgaatgtgtgggatattttgttgatgaggacagatgggtaaatctgccacatattcataatcacctcgatggacatgctgttgcagtaacagaatcctacgtgtatgttgctggatcaatggagccagggtttgctaaaactgtagaaaggtataacccaaatttgaatacatgggaacatgtttgtagtctgatgacaagaaagcattcttttggactaacagaagtcaaagggaagctctatagcattggaggacatggcaactttagtcctggttttaaagatgtgactgtttataatcctgagcttgataaatggcacaacttggaatcggcaccaaagattcttcgagatgtcaaagcactagccattgaagaccggtttgtatacattgccgcccgcactcctgtagaccgggacactgaagatggattaaaggctgtaattacttgctatgatacagagactcgacagtggcaagatgtggaatctttgccgcttattgacaattactgctttttccaaatgtctgtggtcaattcaaacttttatcagacagcatcatgttgtcccaagagttattgtttagaaaacgaagaggcagtaagaaaaattgccagccaagtgtctgatgagatccttgaaagcttgcctccagaagtcctaagcatcgaaggagcagccatttgctattacaaagatgatgtcttcattataggaggctggaaaaacagtgatgatattgataaacagtatcggaaagaagcctaccgatattgtgcggagaggaagaggtggatgcttcttcctcctatgccacaacctcgttgtagagccactgcttgtcacgtgaggatcccataccggtacttgcatggcacacagagataccctatgcctcaaaacctgatgtggcagaaggaccgcatcagacagatgcaagagatacatcgtcacgccctgaacatgaggcgagtgccaagctctcagattgaatgctaggttctctcaagcgtgccgattaaaactgttacacccgtttcgtgaagctgaagatacccaggctgttatttaaaaaagtatgtcgataacttattttctacatgaactgattattaccccatataaaggaaatagagttaaaaactaaagaatgggagactcagttcaatacatggtcattttgttagcttgc

SEQ ID NO: 27860 - DNA, 2172 bp, Homo sapiens
ggccgccatcttggattgcgaactgggtcgctacgcttcacgccaggggcggagtggcggcccttctgttacccgccacacacgtcgccgctggggactgggaaatcagggcatcggagagtgccacattaatggatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaatttgaagctgcatgggcattaacaaatatagcatctggaacttttctgcataccaaggtagtgattgaaactggggctgttccgatttttatcaaacttcttaattctgaacatgaagatgttcaggaacaggctgtttgggcacttggtaatattgctggtgacaatgcagaatgcagagattttgttttgaattgtgaaatacttccacctcttttagagttattaacaaattcaaacagactcacaacaacaagaaatgccgtgtgggccctctcaaatttatgtagaggcaaaaaccctcctccaaactttagtaaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgcacaatgattataaagttgtatcacctgcattaagggcagttggtaatattgtgactggtgatgatattcaaacacaggtaattttgaattgttctgcattaccctgtctcttacatttattgagtagcccaaaggagtcaattagaaaagaagcctgctggactgtttctaacatcactgctggaaatagagctcagattcaggctgttatagatgcaaatatttttcctgttttgattgagattcttcagaaagcagagtttcgtaccagaaaagaagcagcttgggctataactaatgcaacatcaggaggtactccagagcaaataaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcagaaatgacagactttttcattgaatgatgaggacacagcagccatattatgccaagaggaaaaatatcatgatcatattgaaagatcaagcatgagcttccatggtgaagtcttctgtaccaatgcaccagagaatgcctaccatccaaaaaagcagtcagctgatggaaaagaagattattaaacctttgttctgggatttactgttaaaaaacaaacaaaaaacaacaaaaaagcggtgacaggaaacagttaaggaaatgatttaactgaagggaagcaagatttttttaaagcattgttcttaatccccatgactgtccttcagtcacaattccagaataaaagaatctactttgtgtaaaaaaaaaaaaaaa

SEQ ID NO: 27861 - DNA, 1787 bp, Homo sapiens
cccaaggcagtagaagaaatccttctgttgaactctactgtgtcaggccagcctgagttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctattcttccaccagttgtggcgtccagaaagcttccgttttctacggtcctgaccccaaggagggcttggtcagcagcatggagttcccgtgggtggtgtcgctgcaggactcccagtacacacacctggctttcggctgcatcctgagcgagttctgggtcctcagcatcgcatccgccattcagaacaggaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgagtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtc

SEQ ID NO: 27862 - DNA, 1553 bp, Homo sapiens
gttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctattcttccaccagaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgagtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtc

SEQ ID NO: 27863 - DNA, 1787 bp, Homo sapiens
cccaaggcagtagaagaaatccttctgttgaactctactgtgtcaggccagcctgagttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctactcttccaccagttgtggcgtccagaaagcttccgttttctacggtcctgaccccaaggagggcttggtcagcagcatggagttcccgtgggtggtgtcgctgcaggactcccagtacacacacctggctttcggctgcatcctgagcgagttctgggtcctcagcatcgcatccgccattcagaacaggaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgggtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtc

SEQ ID NO: 27864 - DNA, 1553 bp, Homo sapiens
gttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctactcttccaccagaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgggtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtc

SEQ ID NO: 27865 - DNA, 4534 bp, Homo sapiens
gggggcagcggcgccgcagcctgggctggcggaacctcgcgctccgactcgccccccgcctgtagctcggtcggcgttgcgggcaggcgccgctccgctggggattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagaggccgagtgcggtggctcatgcctgtaatcccagcactttgggaggccgaggcaggcagatcacgagatcaggagatcaagaccatcctggccaacgcagtgaaaccccgtctctaccaaaaatacaaaaaattagccaggcgtggtggcgggtgcctatagtcccacctactggggaagctgaggcaggagaattgcttgaacctgggaggcagagattacactgacctgagattgcaccactgcactccagcctgggcaacagagcaagactccgtctcaaaaaaaaaagaaagaaagaaaaaatggtggaaagggtggagaaattccttttaatgggtacaaaccacacaatgcaggtgaccattactctaaaagcccaggcttcatcactatgcaatatatctgtgtaacaaaactgtacttgtgcctgctaaatctgtgaaattaaaaaaaaaaaaaaccatgaatctgatttgcctttagtcaccagatgactgcagataggcacacagaggtgtgagacagcactttccatttgcccttcatctcttgttcctctgccattccccatgaagccgtgctggggctgacctgctggaggatgagacctgtgaagctgagtcagctgccctggtcatcccagccaaggccatgtcctctctgctcagccaacaactgtccaacaaacatgtgaatgagccctgctgaaatcagaactgaccggcccacctgagcctaaattcctgacaaacagatgtgtgaactaagtaaatacttaaaaaaatgagatgctgatggtccctgaatttctcaagaggcaaagaatggtcccacctcgcaacttataaatgttcagaagttagacggccacaaagaagtagcacctcatatacattctcttgctatctacaataaggtgaaggaaggcatttatcttctctgcaaccagaaaacctataacccaaatgcccaggaacacaagaacactgttcaccattctgctgtgcttattagcagaagatatatcagctcacaaaatcccctttgaaacagaaactaaaataatgctcaatgatcattctactcccacgggggaggagggagaggagcataaatcaggacaagagctgggtttagaacttggatcacgtgtggcttttctccatgatcacaaaccccagcttcctataattaataattggatgtattaagtgttttatggagcagtccagccagagagcaactataaaatggaaacatggaccagcttggtaaagggaaagatgaaattgtagaattaatttgtttgttcgttcattgagtatttcataacaataaacttattgtatttataaagggaaaaacctctgggtgtaatttggctgcctggttgtttatatcctacagtgcagtttcagtatgtttcatgttagtgtgcctgttttaaaatgttttacttcattatcgtaagacgtttttaatgcaatgaaacttcaagccagaaaaatcttagaaaattaacgaaatagggagtagagagaaatggagatagcattaaactaaatacaaagaaaaaattgaaacaaatttttttatttgacaaaaattagccgggtgtggtggcaggcacctgtaatcccagctactcaggaagctgaggcgagagaatcgcttgaacctgggaggtggaggcagtgagctgagatcgtgccactgtacatcaccagcctgggcgacagagtgagactccttctccaaaaaaaaaaagagtctcttcattaaaataaacctaatacttcacttgtttagtaaagcaatgcaaattaatacctgatgataaagtcagaagatgtatatatgtttgtgttcctgctttctttcatttcacagtctaattctcccagactaggatttttgctagctatttgttctatcacccagaattttgagaaggcttaaaagcatattattgatttgtgcatttggtgcaaaattcaacaggtataagggggtatctctccctgaacctgatcctcagccttcagtttcctcccttggaataatcactgtatacttctcttgtgtgtctttctaaaaatatgttctgtttatttaaatatatgtgtgtatgtgtatttacacaagtgatggcataccacatacattgttaaacagtttcctcgtgtcctttagcaataaaatctgacgagcagttcttaacacatggagcggcacactataagtgaccagtccctgcccatggccatctggatggttttcatgttgctgtgtaaaggaggcttcaaagtgtcttctgtaggtgtcagcttgactggaaaataaaaagtgtcttctgtactcatcactcatgcttgtgagaatctacaggatagattctgtgtgtgaatctatcctattctaatccttttcggcatttcctcagctacccttactcgttcatttttccaaatgaactttaatatcagtttttctggtacaacttttttccattccagttggttaatttttggattgcaataaatttatgatttaacttttaattttaccctttgtgaacttgaccatagtaagctgttcccatactcaaatatttcctgtcctgtaattgcattttaagttttcctttatgtagaacttgcgtccttcttacgaagtttattcctaagcagtttatcgtttttgttgctgcaataaatggacgtatttcttccttgatgtcctccacctaagattgtctgtatggaaagattgtatatttctgtgtattacatttaatcctgccactgtaatctcttctaatttgtaatttttttcatgtaattattttgggtttctaggtaaataaacatgtcacctacaaaaaaaaaaaaaaaa

SEQ ID NO: 27866 - DNA, 1419 bp, Homo sapiens
gcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatact

SEQ ID NO: 27867 - DNA, 2520 bp, Homo sapiens
acacctgccaagcatcacacctgccaagcatcacacctgccaagcatcacacctgcgatgcctgcacgagctgggtgcggtccgcgcagctgcagtaagggggcgacccggcgtctgttagtcggcggttcatctccttcgtgcctcgatgagctttaacgccattttcctccattctctttcttcacctcttgagtgagtggccatgagctgggctgcaagagtcctggggagcagccagagagcgggcgccgcgggagcgaattgtttttgcccaaggatggttctgtgtctccgccaggcggcatgtgacctgctcgggcgcgggtggcccttcacccctgtgattgtggccagaagtacctctcacctggacctgcggaccccgggcgcagtcctggagctgagaactggaggttgggggaaaagcagggtaaaggggagagaaaagggggtcagctgcgggacggagtgccgtcccagctgtagtttcatgtttggtggagcaacccctgttcctttcctctctctctctcttaattcctcttaactgtactcacgcttccttctccttcccctggtccgcttcatggatgctgagctgcctggccagaacctacccagcttctttgctggtcagatttgtcggtcttttgtgtgtctgcagcacctccttccacacgggcccaggagttctctatacgcgctctcaccgcaggtcttggaattccaagccatttccaattccaggtcttggaaatggctgtgcaatttgtcttcactgttaggtttccaagatggcaactatcaagagtgaacttattaagaatttcgcggaagaggaggccattcatcacaataagatctccattgtaggaactggatcggttggtgtggcttgtgctatcagcatcttattaaaaggtttgagtgatgaacttgtccttgtggatgttgatgaaggcaaactgaagggtgagacaatggatcttcaacatggcagcccttttatgaaaatgccaaatattgtctccagcaaagattacctggtcactgcaaactccaatctagtgattatcacagcaggtgcacgccagaaaaaaggagaaacacgccttgatttagtccagcgaaatgtatccatctttaaattaatgattcccaatattacccagtacagtcctcactgcaaactgcttattgttactaatccagtggatatcttaacttatgtagcctggaagttgagtggatttcccaaaaaccgtgttattggaagtggttgtaatctggactctgctcgttttcgttactttattgggcaaaggcttggcatccactctgaaagctgtcatgggctgatccttggagagcatggcgactcaagtgttcctgtgtggagtggtgtgaacattgctggcgtccctctgaaggatctgaacccagatataggaactgataaagatcctgagcagtgggaaaatgtccacaaaaaagtgatttccagtggctatgagatggtcaaaatgaaaggttatacttcttggggcattagcctatctgtagctgatttaacagaaagtattttgaagaatcttaggagagtgcatccagtttctaccctaagtaagggcctctatggaataaatgaagacatattccttagtgtcccatgtatcctgggagagaatggtatcacagacctcataaaagtaaaactgactcttgaagaggaggcctgcttgcaaaagagtgcagaaacactttgggaaattcagaaggagctcaagctttaaagttgcttaaagctaattctgtagattgaagatgaaatagtagttatggaattgtatatgtcaaacttttgaataaatttgaatttctaaaagttggaaaaatagaggaaagagtgacctatttagtatagccttccagcttttttttttttcttttttgggagggtctcattctgtcacccaggctggagtgcagtggcacggtcatggctcactgcaaccttggcctcccgagctcaggtgagcctcccacttcagcctccagagtaggtgggaccacatgcgtgtgcctccatgcctgcctaatttttgtatctttttgtagagatggggttttgccatgtcatccaagctggttttgaactcccaaagtgctgagattacaggggtgagccactgtgcctggccttagctttgatttagtatccagatgatagatgacactttttttttttttttttaaagtgacggcatcaaagatgtttttggtacttctcagtacttgccttgtatgtatacgtaattgccatctggtccacaagaatgtgtttactgtgttacacaaatcctgattcatcaggtgcatagtaattcttctctatggcttaatacctatgttcatttacatgctatctctacaatgtaaaaataaaagtgtatatatatacacacacacacacagagtaatctaaatgttcctaacactagataaaaccttgatttg

SEQ ID NO: 27868 - DNA, 1680 bp, Homo sapiens
agagtgctgaaggtcctgccaacggctctcttggcgtctcaacgttcggatcagcagcttttttccattctctctctccacttcttcagtgagcagccatgagttggactgtgcctgttgtgcgggccagccagagagtgagctcggtgggagcgaatttcctatgcctggggatggccctgtgtccgcgtcaagcaacgcgcatcccgctcaacggcacctggctcttcacccccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgattatcacagcaggtgcacgccaagaaaagggagaaacgcgccttaatttagtccagcgaaatgtggccatcttcaagttaatgatttccagtattgtccagtacagcccccactgcaaactgattattgtttccaatccagtggatatcttaacttatgtagcttggaagttgagtgcatttcccaaaaaccgtattattggaagcggctgtaatctggatactgctcgttttcgtttcttgattggacaaaagcttggtatccattctgaaagctgccatggatggatcctcggagagcatggagactcaagtgttcctgtgtggagtggagtgaacatagctggtgtccctttgaaggatctgaactctgatataggaactgataaagatcctgagcaatggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataattaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctatttatttagtcctccagctcttttattgagcatccacgtgctggacgatacttatttacaattcctaagtatttttggtacctctgatgtagcagcacttgccatgttatatatatgtagttggcatttggttcccaaaaagtaggatgtaggtatttattgtgttctagaaattccgactcttttcattagatatatgctatttctttcattcttgctggtttatacctatgttcatttatatgctgtaaaaaagtagtagcttcttctacaatgtaaaaataaatgtacatacaaaaaaaaaaaaaa

SEQ ID NO: 27869 - DNA, 1336 bp, Homo sapiens
ggggcttgcagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgcgaaaaaaaaaaaaaaaaaaaaaaaaaaaaa

SEQ ID NO: 27870 - DNA, 779 bp, Homo sapiens
gtgaaactcacccagctttagtaaccaactcgattgcatagactttagataaccatgtgaaggggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaac

SEQ ID NO: 27871 - DNA, 1070 bp, Homo sapiens
gcacttctgggcttcagcacacatcagtgtggttcacgtgtttcctgctgttatgaaagagattggagaggactaagcttggaattgcctgtcccacagcaagaggctatggagctgggccacggagcagggcccatctgaatgacaaggagggccaacaggacttggacccctggaaagcggcctacagttccttggacacctccaagttcaagaaccagggtctgtcatccccacagcccctgcccctgggatccagcactcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagcttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27872 - DNA, 1329 bp, Homo sapiens
gcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27873 - DNA, 1157 bp, Homo sapiens
cgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctcaaaaaaaaaaaaaaaaa

SEQ ID NO: 27874 - DNA, 2244 bp, Homo sapiens
aatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtatgaataccctattcagcggtcaaagaaagattctgagggaatagaaatgggagtcgcaggttctgtaagccttctgcagaatgttacgttgtccacccagcccatttcaagtttggattggagtccagataaaaggggtctctgcgtctgtagttcatttgaccaaacggtgagagtactgatcgttacaaagctcaataaaatttgacttcaagactttggacttgaggctgggcacggtggctcactcctgtaatcccagcactttgggaggccgaggcgggtggatcagaaggtcaggagatcgagaccatcctggctaacatggtgaaaccccgtctctactaaaaatataaaaaaaaatttgctgggtgtcatggcgggcatctgtagtcctagctacttgggaggctgaggcaggagaatggcgtgaacccgggaggcggaggttgcagtgagccgagattgtgccactgcactccagcctgggcaactgagcaagactgtctcaaaaaaaaaaaaaaaaaaaaagactttggacttgaaaccttccagaggaacactcacacaatttaagataggttctggagtcctctgaccctcattgaacaaagctggatttggctgatgataaaagaccccagccacaagcctctgggccagcctccagcctctctcggggcttgtttgctgacttgctgctgcacgtgggtatcagaagcaccaagtaaactatctccagggccagttcttttctctcccttccatttctaagtcaatagttgtctataattaaacatatttcagatttgttctgtgtccctgaagttccatattttatctttatgcttgtgttatgttttagtgtctataatgttgtggtgggaatcatttcatttggtttaaaagagtttgccttggaaaaactgaattaaccttcataaatacattttgagagatttcagtgtgagtaattttctggacataatattattgtataaaatatcaaaatggtgggccaggcgtggtagctcacgcctgtaattccagcactttgggaggctgaggcgggtgaatcacgaggtcaggaattcgagaccagcctggccaacatggtcaaaacccgtctctactaaaaatacaaaaaattagctgggcttagtggcgggcgcctgtaatcacagctacttgggaggctgaggcaggagaatcacttgaacccaggaggtggagattgcagtgagctgagattgcgccactgcactccagccctggcgacagagtgagactccgtctc

SEQ ID NO: 27875 - DNA, 1079 bp, Homo sapiens
ggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggatgatttattgattgaagtatctgagaagtacagattacatctgaatcttccaaaacttattgatactgaaatgaccacagcaaaatttatcaaagaaaaatccacgctaatcatcacaatgcctttggtgtgaaagaagagcatcatatgttttgggttttcagtgctaaagtcatgtgaattaaaggaccttcattttggccaaaaaaaaaaaaaaaaaaaaaaaaaaaaa

SEQ ID NO: 27876 - DNA, 5019 bp, Homo sapiens
tagtagcagagtatgccacaacttctaggatcaggaaagacctctcctagcttcctactggatatctttattagcatttttgtagattctgtgaaaaagaagaaataaaacgaaatcacccacattttcaaaatgttcttcaaaatgaaaaatgagatagacaatgaccctgaatcagaaaaatgcatcaaggattccaccatcatgagaagagagccccaaaatatccttagtcctttgatgctccctaaccttgagatcccattctcagtaaaggatatcatctctaggattgagcgcgcacagctccatcgagccagagaggacattgatatgcagctgagtgaaataatgaacaatgtgcatcggataatgactcgctatactcttgtttttaactcgtcctctgaaaggaatgtctcccttacagaacataagaaaaaacagagaaccaattttcttgagaaaatggctacttacgctaagactattgaaataagagaaaagactcttgccaacattctggcctggttggaagaatggaatgatgttttgtctgagatgactctaatggatgttgatgaacaccaccactggatagcacaaatggagttgttaccggacacgttaaaagctattgagaacaatgtcaagatactaagcagatttagtacatctttcctcgacgaaaagaagaaacaaaagaaaaaaatattatctagaggtactctatggaaatcttggaaagaaagagttataaaacgaccttcaacagcccgtgctttaagaccagatcagatgattagtgatcaacttgcaacaaatacaaaggtttcagaaatccaaggtatgctacaggaactcataggcaccacaatgttcagtacattggaaaacaatgctattaaatatatatcatcaacaatagtaaacctttctacagctttgagtatgctaaatgatgaattaaaatgtgttaacttccaaagttccactgtgtatgcacatgagacaagtgaagcagaaaaggagctctctctgaagataatacgagatctcagtaacgaaaatgaaatgcttcagcagaaacttcaagatgcagaagaaaaatgtgaacaacttattcgatccaaaattgttatagaacaactatatgcaaaattgtccacatcatcaaccttgaaagtgttacctggaccttctccacagtcatccagggcgataatcaaagttggtgatactgaggacaatatggacaatattttagacaaggaacttgaaaatattgtagatgaagtccaaagaaaagagaccaaggactctgggataaaatgggactccactatttcatatacagcccaagctgaaagaactccagatttaactgaactacgacagcaacctgttgcttctgaagatatttccgaagacagcactaaagataacgtatcattgaagaaaggtgatttctatcaggaagatgagactgatgagtatcaatcatggaaaagaagccacaaaaaagccacatatgtatatgagacctctggaccaaatctgagtgataataaaagtggacagaaagtctcagaggccaaacctagtcaatactatgagctacaagtactgaaaaagaaaagaaaagaaatgaaatccttttctgaagataaatcaaagtcacccactgaagcaaaaagaaaacatctctctttaactgaaacaaagagccaaggtggcaaaagtggaacaagtatgatgatgttggagcaatttaggaaggtcaaacgtgaatctccatttgacaaacgtccaactgcagcagagattaaagtggaacccaccactgagtcattggacaaagagggcaaaggtgaaattagaagcctagtggagccactcagtatgatccaatttgatgatactgctgagccacagaaaggaaaaataaaaggaaagaaacaccatatctcttcaggaactatcacaagcaaagaagaaaaaactgaagagaaggaagagttgaccaaacaagtcaagtctcatcaacttgttaaatcactctcaagagtggctaaagagacttcagaatctaccagagttctagaaagtccagatggcaaaagtgaacagagtaacctcgaagaatttcaggaagccataatggctttcctaaaacagaaaattgataacataggaaaggcttttgacaaaaagactgttccgaaggaagaggagttattaaaaagagcagaagctgaaaaattaggaatcataaaggcaaaaatggaggaatatttccaaaaagtggctgaaactgtgactaaaatcttgagaaaatacaaagatacaaaaaaggaagaacaagttggagagaaacctataaaacaaaaaaaggtagtctcatttatgccaggattgcattttcagaagtcaccaattagtgcaaaatctgaaagcagtaccctcctctcatatgagagcacagatccagtaattaacaatttaatacaaatgatcttggctgaaatagaaagtgaaagagatattccaacagtctcaacagtacagaaagaccacaaggagaaggaaaaacaaaggcaggagcaatatttgcaagagggtcaagaacaaatgtctggcatgagtctcaaacagcagttgctgggagaaagaaatctcttgaaggagcactatgagaagataagtgagaattgggaagaaaaaaaggcatggctccagatgaaggagggaaagcaagaacaacagagccagaaacagtggcaggaagaagagatgtggaaggaagagcaaaaacaggcaactccaaagcaggctgagcaagaggaaaagcaaaagcaaagaggacaggaggaagaagagcttccaaagtcaagcctgcagcggctggaagaagggacccaaaaaatgaaaacacaagggttgctcttggaaaaggagaatggacagatgaggcagattcagaaggaagcgaaacatttggggccacacaggagaagggagaaagggaaggaaaagcagaagccagagagagggctagaggacctcgaaaggcagatcaaaacaaaggatcagatgcagatgaaggaaacacaacctaaagagctagaaaaaatggtcatccaaactccaatgacattatctcccaggtggaagagtgtattgaaagatgtacagcggtcatatgaaggaaaagagtttcagaggaatctgaagacattagagaaccttcctgatgaaaaggagcccatatcaatcacacctcccccctccctacaatactccctgcctggagctcttcctatttctggccagcctctcactaaatgcattcatctcacacctcagcaggcccaggaagtggggatcacactcactcctcagcaggcccaggctcaggggatcacgctcacccttcagcaggcccaggaactagggatccctctcacccctcagcaggcccaggccctggagatccttttcacccctcagcaggcgcaggccctggggatccctctcacccctcagcagacccaggttcaagggatcactctcacccctcagcaggaccaggccccggggatctctctcaccactcagcaggctcagaaactagggatccctcttacccctcagcaggcccaggccctggggatccctctcacccctcagcaggctcaggaattggggatccctctcacccctcagcaggcccaggccctgagggtctctctcacccctcagcaggctcaggaattggggatccctctcacccctcagcaggcccaggccctggggatcactctaacccttcagcaggcccagcaattggggatccctctcacccctcagcaggcgcaggctctcggaatcactctcacccctaagcaggttcaggaactggggatccctcttactcctcagcaggcccaggccctggggatcactctcacccctaagcaggctcaggaattggggatccctctcaaccctcagcaggcccagaccctggggatccctctcacccctaagcaggcacaggctctggggatccctttcacccctcagcaggcgcaggccctggggatccctctcacccctcagcaggcgcagactcaggagatcactctcacccctcagcaggcccaggccttggggatgcctctcaccactcagcaggctcaggaactggggatccctctcacccctcagcacgctcaggccttggggatgcctctcaccactcagcaggctcaggaactggggatccctctcacccctcagcaggctcaggccttggggatgcctctcaccactcagcaggctcaggaactggggatccctctcacccctcagcaggctcaggaattggggatccctttcacccctcagcaggcacaggctcaggagatcactctcacccctcagcaggcccaggccctggggatgcctctcaccgctcagcaggctcaggagctggggatcactctcacccctcagcaggctcaggaattggggatccctctcacccctcagcaggcccaggccctggggatccctctcatccctccgcaggctcaggaattggggatccctctcacccctcagcaggcccaggccctggggatccttctcatccctccgcaggctcaggaattggggatccctctcacccctcagcaggcccaggccctggggatccctctgatccctccgcaggctcaggaattggggatccctctcacccctcagcaggtccaggccctggggatccctctcatccctccgcaggctcaggaattggagatccctctcacccctcagcaggcccaggccctggggatccctctcacccctcagcaggcgcaggaactggggatccctctcacccctcagcaggcgcaggaactggggatccctctcacccctcagcaggcgcaggctcaggggatccctctcacccctcagcccaggcactgggagtccccatcaccccagtaa

SEQ ID NO: 27877 - DNA, 5988 bp, Homo sapiens
tagtagcagagtatgccacaacttctaggatcaggaaagacctctcctagcttcctactggatatctttattagcatttttgtagattctgtgaaaaagaagaaataaaacgaaatcacccacattttcaaaatgttcttcaaaatgaaaaatgagatagacaatgaccctgaatcagaaaaatgcatcaaggattccaccatcatgagaagagagccccaaaatatccttagtcctttgatgctccctaaccttgagatcccattctcagtaaaggatatcatctctaggattgagcgcgcacagctccatcgagccagagaggacattgatatgcagctgagtgaaataatgaacaatgtgcatcggataatgactcgctatactcttgtttttaactcgtcctctgaaaggaatgtctcccttacagaacataagaaaaaacagagaaccaattttcttgagaaaatggctacttacgctaagactattgaaataagagaaaagactcttgccaacattctggcctggttggaagaatggaatgatgttttgtctgagatgactctaatggatgttgatgaacaccaccactggatagcacaaatggagttgttaccggacacgttaaaagctattgagaacaatgtcaagatactaagcagatttagtacatctttcctcgacgaaaagaagaaacaaaagaaaaaaatattatctagaggtactctatggaaatcttggaaagaaagagttataaaacgaccttcaacagcccgtgctttaagaccagatcagatgattagtgatcaacttgcaacaaatacaaaggtttcagaaatccaaggtatgctacaggaactcataggcaccacaatgttcagtacattggaaaacaatgctattaaatatatatcatcaacaatagtaaacctttctacagctttgagtatgctaaatgatgaattaaaatgtgttaacttccaaagttccactgtgtatgcacatgagacaagtgaagcagaaaaggagctctctctgaagataatacgagatctcagtaacgaaaatgaaatgcttcagcagaaacttcaagatgcagaagaaaaatgtgaacaacttattcgatccaaaattgttatagaacaactatatgcaaaattgtccacatcatcaaccttgaaagtgttacctggaccttctccacagtcatccagggcgataatcaaagttggtgatactgaggacaatatggacaatattttagacaaggaacttgaaaatattgtagatgaagtccaaagaaaagagaccaaggactctgggataaaatgggactccactatttcatatacagcccaagctgaaagaactccagatttaactgaactacgacagcaacctgttgcttctgaagatatttccgaagacagcactaaagataacgtatcattgaagaaaggtgatttctatcaggaagatgagactgatgagtatcaatcatggaaaagaagccacacaaaaggcacatatgtatatgagacctctggaccaaatctgagtgataataaaagtggacagaaagtctcagaggccaaacctagtcaatactatgagctacaagtactgaaaaagaaaagaaaagaaatgaaatccttttctgaagataaatcaaagtcacccactgaagcaaaaagaaaacatctctctttaactgaaacaaagagccaaggtggcaaaagtggaacaagtatgatgatgttggagcaatttaggaaggtcaaacgtgaatctccatttgacaaacgtccaactgcagcagagattaaagtggaacccaccactgagtcattggacaaagagggcaaaggtgaaattagaagcctagtggagccactcagtatgatccaatttgatgatactgctgagccacagaaaggaaaaataaaaggaaagaaacaccatatctcttcaggaactatcacaagcaaagaagaaaaaactgaagagaaggaagagttgaccaaacaagtcaagtctcatcaacttgttaaatcactctcaagagtggctaaagagacttcagaatctaccagagttctagaaagtccagatggcaaaagtgaacagagtaacctcgaagaatttcaggaagccataatggctttcctaaaacagaaaattgataacataggaaaggcttttgacaaaaagactgttccgaaggaagaggagttattaaaaagagcagaagctgaaaaattaggaatcataaaggcaaaaatggaggaatatttccaaaaagtggctgaaactgtgactaaaatcttgagaaaatacaaagatacaaaaaaggaagaacaagttggagagaaacctataaaacaaaaaaaggtagtctcatttatgccaggattgcattttcagaagtcaccaattagtgcaaaatctgaaagcagtaccctcctctcatatgagagcacagatccagtaattaacaatttaatacaaatgatcttggctgaaatagaaagtgaaagagatattccaacagtctcaacagtacagaaagaccacaaggagaaggaaaaacaaaggcaggagcaatatttgcaagagggtcaagaacaaatgtctggcatgagtctcaaacagcagttgctgggagaaagaaatctcttgaaggagcactatgagaagataagtgagaattgggaagaaaaaaaggcatggctccagatgaaggagggaaagcaagaacaacagagccagaaacagtggcaggaagaagagatgtggaaggaagagcaaaaacaggcaactccaaagcaggctgagcaagaggaaaagcaaaagcaaagaggacaggaggaagaagagcttccaaagtcaagcctgcagcggctggaagaagggacccaaaaaatgaaaacacaagggttgctcttggaaaaggagaatggacagatgaggcagattcagaaggaagcgaaacatttggggccacacaggagaagggagaaagggaaggaaaagcagaagccagagagagggctagaggacctcgaaaggcagatcaaaacaaaggatcagatgcagatgaaggaaacacaacctaaagagctagaaaaaatggtcatccaaactccaatgacattatctcccaggtggaagagtgtattgaaagatgtacagcggtcatatgaaggaaaagagtttcagaggaatctgaagacattagagaaccttcctgatgaaaaggagcccatatcaatcacacctcccccctccctacaatactccctgcctggagctcttcctatttctggccagcctctcactaaatgcattcatctcacacctcagcaggcccaggaagtggggatcacactcactcctcagcaggcccaggctcaggggatcacgctcacccttcagcaggcccaggaactagggatccctctcacccctcagcaggcccaggccctggagatccttttcacccctcagcaggcgcaggccctggggatccctctcacccctcagcagacccaggttcaagggatcactctcacccctcagcaggaccaggccccggggatctctctcaccactcagcaggctcagaaactagggatccctcttacccctcagcaggcccaggccctggggatccctctcacccctcagcaggctcaggaattggggatccctctcacccctcagcaggcccaggccctgggggtctctctcacccctcagcaggctcaggaattggggatccctctcacccctcagcaggcccaggccctggggatcactctaacccctcagcaggcccagcaattggggatccctctcacccctcagcaggcgcaggctctcggaatcactctcacccctaagcaggttcaggaactggggatccctcttactcctcagcaggcccaggccctggggatcactctcacccctaagcaggctcaggaattggggatccctctcaaccctcagcaggcccagaccctggggatccctctcacccctaagcaggcacaggctctggggatccctttcacccctcagcaggcgcaggccctggggatccctctcacccctcagcaggcgcagactcaggagatcactctcacccctcagcaggcccaggccttggggatgcctctcaccactcagcaggctcaggaactggggatccctctcacccctcagcacgctcaggccttggggatgcctctcaccactcagcaggctcaggaactggggatccctctcacccctcagcaggctcaggccttggggatgcctctcaccactcagcaggctcaggaactggggatccctctcacccctcagcaggctcaggaattggggatccctctcacccctcagcaggcacaggctcaggagatcactctcacccctcagcaggcccaggccctggggatgcctctcaccgctcagcaggctcaggagctggggatcactctcacccctcagcaggctcaggaattggggatccctctcacccctcagcaggcccaggccctggggatccctctcatccctccgcaggctcaggaattggggatccctctcacccctcagcaggcccaggccctggggatccctctcatccctccgcaggctcaggaattggggatccctctcacccctcagcaggcccaggccctggggatccctctgatccctccgcaggctcaggaattggggatccctctcacccctcagcaggtccaggccctggggatccctctcatccctccgcaggctcaggaattggagatccctctcacccctcagcaggcccaggccctggggatccctctcacccctcagcaggcgcaggaactggggatccctctcacccctcagcaggcgcaggaactggggatccctctcacccctcagcaggcgcaggctcaggggatccctctcacccctcagcaggcccaggctctggggatctctctcacccctcagcaggcgcaggctcaggggatcactctcacccctcagcaggcccaggcactgggagtccccatcaccccagtaaatgcctgggtgtcagctgtcactcttacctctgagcaaacccacgctttggagtcccctatgaacttagaacaggctcaagaacagttattgaagttaggggttcctctcaccttagataaagcccataccttgggatcgcccctcacccttaagcaagtccagtggtcccatagaccatttcagaaatcgaaggcttctctccccactgggcaatccatcatatcaagattgtctccaagtcttaggctgtccctggcatcatcagctcctactgctgagaagtcctctatattcggggtctcttctactcctttgcagatatcaagggttcccctcaaccaaggcccctttgcccctgggaagcccctagaaatggggattctttctgagcctgggaagcttggggcaccacagactcttcgttcctctggacagaccctggtatacggaggtcaatccacttctgcgcagttcccggcaccacaggcccctccctcccctgggcagctcccaatatctcgggcccctcccactccagggcagccctttatagctggagttccacccacttctggacagattccaagtctctgggctcctctttctcctgggcagcccttagttcctgaagcctcttccatccctggggacctcctggaatctggacccttaaccttctctgagcagctccaggaattccagcctcctgccactgctgagcaatctccctatctgcaggctccttctacccctgggcagcatctggcaacatggacccttcctgggcgagcttcttcattatggatccctcccacctctagacatcctcccacactatggccgtccccagcccctggaaagccccagaaaatgctccagatttcaaggtag

SEQ ID NO: 27878 - DNA, 774 bp, Homo sapiens
agaacatccttctccctcagctggagggagcatggcagtgagccaaggagacgggaccctctgctttgtcctcctgctgtgctgttggcaagaaactgagctccggccgagaaccgtgattccaggttcacctactgaaataccattcagttcaaaacaggaggatatgtctgaattattagatgaaattctggtccaggagattttggatctgaataaaacaacaccgagcgaaatgccaagtacagcatcaacattatcaacaccgttacatgctggtattgatgagaattatcaagctggtggttctgagaattaccatgaattattagagaatttacaattctctcctggcattgaggacaaaatttccaatgatgaagccaatgctaatgcaaatctccatggcgatccttctgagaattatcgtgggccacaggtgtctcctggcagtgagaagagtgtttccagtaaagaaaagaattcaaagaacactcagtatgaaaatctatccattctggaccaaatccttcaaaatattggaagatcttcaggaaacattttccataaagagcagcagaggaccagcgcacagaggaggagccaaggcagtcagtgaggccgcagccccagaccccctgcgcaggagaggagcctgctagaacccccacccaccagcctccggaacagggcacttgtgtgcacacgcccacgttctctgaaccattccacataaaggaaaatcgtttattcacaccaaaaaaaaaaaaaaaa

SEQ ID NO: 27879 - DNA, 1948 bp, Homo sapiens
gggagtacctgtacctttcagctgcgccggccgcgaggccacggagagctcgccttggagagcccaggagcaggggagacatggactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagttagtctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaaccgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacaggccatataaatgtcaggaatgtgggagagccttcatttatccctcgacatttcaaagacacatgacaacacacactggagagaagccctataaatgtcagcactgtgggaaagccttcacttacccccaggcttttcaaagacatgagaagacgcacacgggagagaagccctatgaatgcaagcagtgtgggaaaacattcagttggtctgaaaccttgcgagtccacatgaggatccacaccggggacaaactctataaatgtgaacactgtgggaaggcttttacctcttccagatcattccaaggtcatttgaggacgcacactggagagaaaccttatgagtgtaaacaatgtgggaaagccttcacttggtcctcaacgtttagagaacatgtgagaattcacacgcaagagcagctctataaatgtgaacaatgtgggaaggcttttacctcttccagatcattccgaggtcatttgaggacgcacactggagagaagccttatgagtgtaaacaatgtggaaaaaccttcacttggtcctcaacgtttagagaacatgtgagaattcacacgcaagagcagctccataaatgtgaacactgtgggaaggcctttacctcttccagagcattccaaggtcatttgaggatgcacactggagagaagccttatgagtgtaaacaatgtggaaaaaccttcacttggtcctcaaccttacataatcatgtgaggatgcacactggagagaaacctcacaaatgtaaacaatgtgggatgtccttcaagtggcactcctccttccggaaccatctgaggatgcacacaggacagaaatcccacgaatgtcagtcatactcaaaagccttcagttgccaagtcattctttctaaaaccagtgagagcacacactaaagagaaattctataactttaatggggtaacctcacattaattcatgtataatgctccagaaaattcacaccaggagagaaatcttacaagtatgatattgtctttgtcaatacctcatttgtaaaacagacccattagtcgtgaatttccagctctttcaaaaataaatgtttatgtgagaaaataaaaaaaaaaaaaaa

SEQ ID NO: 27880 - DNA, 3104 bp, Homo sapiens
ggacgtttacgctgactcctccagtgcctcatcaatgaagtaagcaggcagctacgttctggatggctagcatgtaccgaaggcacaaaacctccagagttggcagagttaagtcctggcgtgcccgaggctatccaggggaacacgcgggacagacagcaccctcagcctgtccccatgaccctctgctccagtctgaggggcaggacaccatgagacctctcagacacagagtccaccctcgacatgacccggatgaaaggcaggagtgtgtgccctgcttttgccctcgaagctcgctgaaggggacccatctctgcaagcccacagccctacctgcagcatccacagcctcagagagcagcggggccccttacccctgaaccccctccaagagcatcaggacaacaagccttgagctgtggagacaagagaaccagtatccctggcccagggaggattccaggagaggacacgggcaggagccctggcccagagccagaaccaagagtccagccagcgaaactggaactagggtccccggcacccaggactctgcgagcatcccccaacagcaagcccttctgcaagggagacgggttggcccaccccaggctgtccagctccagcagccttgcaggcagcctctccagaaaaagagcctggtcctccccaccctgctccccacaggctgtccctgaccctgaggcccagaggcacaagaggacttctgtagagcccaggggagcaggctgttctcttggggccccagcgggctcaaggtgtggccaggctgtccccaactcaggatagatcataggctgtcctgcgtacctcctctggaactccctgcccaagctctgccatggacctggacgtcaggggcctgtggtttaactttgaatagggattctggaccttacacgtgtgccctggacagccccagaaccatggggtggggaccgacccagcaagcccaccggggccctgaaacccggccctgccggacactgtgataataaccaagaggcaagtccagagacatccactttgcccaatggcacctgcatccaacttctcagcaggcagtgactggcatggtgtgggggcagccggggcagcacctggccagcacctggccagctgccctgtagcccccgatggctccagtgcctctggacctcattttctactttctacggggaaacctactccctcagaggccaccagagggaagagtgagcaaggcgttcctgcagtcccgaccagccagcggcatgtcctgtggcctctgactcaacctatgagacagagctctgatcccagggcacacttcccaggacacggggcccagcctcaaccagagccctgtgaagggaggggcaccaggatgaccacatgggggaccatggcgctgcacacctgggcactgtacttctcattggagaatccaggcaagatcttgaagcaggtgcatgaggtcctgagcctgtgcagcaaacagcactcatctggggttggcacgaaggggtctacagagccacggccaccgcagcctcttcccggccccatctgtgcagtgcaagtgatccacgcctgctcctaaacccagcccagcaagcagcagcagcccgggcccccaagcccgccaggccaatgtgctgcccagaggcttcgaggccctgcccgctgtacctcccaccacctggaagctgcctcctgacgccttccagccactgctgcagccgcaacaggtgtcgcggccagtgcaggctttccagacggtggcagcgcccagcagccgttgcctcagctctttggtggcagccaggccaacaagggcagcgacgatgactaggatgatgagtgagcaaacagctccacactggtggacaggctgggtgcgcacccggtggtcctcaaaggctcgctgggcctgtaccaccgttataaatttgagatcatgagattataccgtttgccttcttgctttttgaagtacgagtatttttatgcacactttgtagacttcaaaatccatgaagagtctcaaagaagccggatggatggagcctgctgcggatgccttttactctcgtagatcagggtgatttacattccacctgtagtctgcttgcaaacacacagagcagccttgcagctttgtgcctttagactcttggttttgcatttctccctgctcccttcttccttccagtaagctgcaacttttctgattgaaagggtgcaaggctaacacacggaatgactaactcaggatcacatactggcagtgggagaggcaggaggagcagctgccatcaattgccagggccaagtggatgataggatggatgctggtgcatgcggaggaggcagacgcaacgctcatctctaataatgatgtctgttccctcagaggcggctagagcatcacctcttcacgcaagtgtcttgaaactcagcttgaagatttcagcaaatgtgtcttacagagaagagaagagggagtcagcccatcgggattaaaaatatagaggcagtgacaacacacactcggcttcagttcttaggagagttttggttttgatttttttttttttttggagaagattttttttttaatggatctacactgttaactgagactctgttgagattcactggtttacttaaaaacttctcagggatgtctgtaaatttcagtgttatatgtcatgaaaactggtgtgggcagatctgttggttgaaataatttctactgtttcaatgtttttgtagttactgagctaaatcatatggtaattgacagtttctaaatctgtcacctaaaggttaaattatctactgttgccgtgaagtcaaacttactgctgcctcagaaatccctgggtaccgcgatggtcatacagaagtaaggaagtcaatttgaaatgtcagtgagtcaaaatgattaaagaggccaggtgcagtggctcacgcttgtaatcccagcactttgggaggctgaggcagtggattgcttgagtccaggagtttgagatcaacctgtgcgacatggcaaaaccctgtctctacaaaaaatacaaaacaaatttatccag

SEQ ID NO: 27881 - DNA, 1251 bp, Homo sapiens
agttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttgaaaaaaaaaaaaaaaa

SEQ ID NO: 27882 - DNA, 1120 bp, Homo sapiens
aaacacacaggcttatggagaaacgaagagaaagaatacataacttcctgagtgaactgttgaaagagaaacttgacaatgaagatatgattattgctagagatattgcagaagctgaggctgaatgggaaaaaagagaaagagaaaaagatgaaaaaaacaaagcagaattaaaaacaattgcagaatatcgagccattgtgatgaaaaataaagaggaagaagaaagacaaagaaaaatagaggctaaagaacaattgctggctgtcatgaaagcagatcagattttctgggaacatgaaaaggagaaaaaatgcaaagctgataaagaacatcaagaggttcaagatgcccatattcagcaaatggccaaaaataagtttaatgcaaagcaagcaaaacaagcagaattagattattgcagacttactgaagctcttgtggctgaaaaggagaaagaatttcaggactatgccagagaggtaattgaacttgaatcggaaacaacaaataaatatatttaccctcttgtaaaagctgtacaggaaggacctggaggtggccgtggaccagtgtttgtggacagaggtggattaagacccagctatcaggcaaatgatgttactggagtccagctccctttttataactctcagggaccaaaatataattttcaaaagtcaaagagaaggctaggttttacatggtagaaaaaaattatttttaacattgagaagactaagttgtagcatatatgagcttcaaatataaatggatttcagttaataaagctgttcttcatctaagtacaattatgtctgatttaattgattgttctcagtatttcttttgggtatatataaaaccccaattttgagattcctttttttaactgtggtaaaatacacaagtttactttttaaatgtacattcagtggtattaagtacattcaaaatattgtgtagccatgaccattgtgtagttccagaatttttcagtgctcttactagaaaccccatacccattcattaagcagtcactccccattccccttccccacagctcctggtaactttatctgctttgcctatactgggtattttgaataaacagaatcat

SEQ ID NO: 27883 - DNA, 1120 bp, Homo sapiens; identical to SEQ ID NO: 27882

SEQ ID NO: 27884 - DNA, 447 bp, Homo sapiens
gccagtttttttacagtggctctgaaatgagagaaattgcagaaattctccctgctcaggaaaaggtagaggcaaggattgacttaaagatgggtaagaagcgtgttactgatcataagctaaatgtggacaaagtaattaaaaatattaacacaatttcttcggagttgaagaagataaaagagctctcccagttattgctttgtgaccttatcctacattttaatcatcccatcaagactgagaacttagcagaagcagaaagaaacaaccccctctttgaagagtctaaaatatcagatgtatcccttgtttctaacagtttttctatctgatttcttatttgttatgagtttctgttttattgttgaactaacaaatatttgggagagttgagtttactaatttgtatatatataatttaaaacaaaataaaaataatgtaaa

SEQ ID NO: 27885 - DNA, 1507 bp, Homo sapiens
gtttgggagggtgaagaccgctgaaatttccaggctgcccgaggctccaccttccaccacccaacgggtgggcggtgggccgggctggcctcggagcctctccctgggtgtcggttgggccgagaaggggacggttggctgggtgggcctggcggctggtggctgtccgtaggccggggtcactctgagggcattttacattaccctaatcctgtccacttggcaagaaacttagtaagccccaaaggttcattccaaatcctgtctgggagggcgaggactgtggaaacttccagatgcctcaggctccatctttagctgttgagcgggtggttgggccgctcatggccccaaagatctggggggtcttcatgggcagttgggtcgctgagggccctaaagatctggggctcctcccaggtgtcagttgggccaaggaggaggctgggctttcagagtagaacctgcggtgctaacgatggctctgcagggctgcgggctgagggcctgggcggcgtcctgtggcccggagatggcgctctagtggtatcaggccttgagtcagcgacatcctggcttctgaccccccattcctatggcccctacagtctggtctccgcttccccactcccggtgaattgctgttggagcagcctctcctttctgggtagtggcctggccgagctccccggggagggcttgacccagacctgtcctgcctccagtccagtcccagctacattgttgtgtagcaccccactgtgccctcaccccacccacgcgctgggtgctcgagggcctaggagaaccagagtggagagaggccactgtcttgggctctaaaatcatttagtttctactttactatttttaaaaaacttttgccttgtttttgaagttctttaattccaccactccaccccttgttaaaatatcatctttctttttccctgcaacttgactcttggtttggcatgcccaaggaaggcagctgacatcctggagaatggggtcttgggggtagatgcaaagcgcattttattaatgtctgggaaacaaaattagtttttttacagtggctctgaaatgagagaaattgcagaaattctccctgctcaggaaaaggtagaggcaaggattgacttaaagatgggtaagaagcgtgttactgatcataagctaaatgtggacaaagtaattaaaaatattaacacaatttcttcggagttgaagaagataaaagagctctcccagttattgctttgtgaccttatcctacattttaatcatcccatcaagactgagaacttagcagaagcagaaagaaacaaccccctctttgaagagtctaaaatatcagatgtatcccttgtttctaacagtttttctatctgatttcttatttgttatgagtttctgttttattgttgaactaacaaatatttgggagagttgagtttactaatttgtatatatataatttaaaacaaaataaaaataatgtaaa

SEQ ID NO: 27886 - DNA, 1507 bp, Homo sapiens
gtttgggagggtgaagaccgctgaaatttccaggctgcccgaggctccaccttccaccacccaacgggtgggcggtgggccgggctggcctcggagcctctccctgggtgtcggttgggccgagaaggggacggttggctgggtgggcctggcggctggtggctgtccgtaggccggggtcactctgagggcattttacattaccctaatcctgtccacttggcaagaaacttagtaagccccaaaggttcattccaaatcctgtctgggagggcgaggactgtggaaacttccagatgcctcaggctccatctttagctgttgagcgggtggttgggccgctcatggccccaaagatctggggggtcttcatgggcagttgggtcgctgagggccctaaagatctggggctcctcccaggtgtcagttgggccaaggaggaggctgggctttcagagtagaacctgcggtgctaacgatggctctgcagggctgcgggctgagggcctgggcggcgtcctgtggcccggagatggcgctctagtggtatcaggccttgagtcagcgacatcctggcttctgaccccccattcctatggcccctacagtctggtctccgcttccccactcccggtgaattgctgttggagcagcctctcctttctgggtagtggcctggccgagctccccggggagggcttgacccagacctgtcctgcctccagtccagtcccagctacattgttgtatagcaccccactgtgccctcaccccacccacgcgctgggtgctcgagggcctaggagaaccagagtggagagaggccactgtcttgggctctaaaatcatttagtttctactttactatttttaaaaaacttttgccttgtttttgaagttctttaattccaccactccaccccttgttaaaatatcatctttctttttccctgcaacttgactcttggtttggcatgcccaaggaaggcagctgacatcctggagaatggggtcttgggggtagatgcaaagcgcattttattaatgtctgggaaacaaaattagtttttttacagtggctctgaaatgagagaaattgcagaaattctccctgctcaggaaaaggtagaggcaaggattgacttaaagatgggtaagaagcgtgttactgatcataagctaaatgtggacaaagtaattaaaaatattaacacaatttcttcggagttgaagaagataaaagagctctcccagttattgctttgtgaccttatcctacattttaatcatcccatcaagactgagaacttagcagaagcagaaagaaacaaccccctctttgaagagtctaaaatatcagatgtatcccttgtttctaacagtttttctatctgatttcttatttgttatgagtttctgttttattgttgaactaacaaatatttgggagagttgagtttactaatttgtatatatataatttaaaacaaaataaaaataatgtaaa

SEQ ID NO: 27887 - DNA, 447 bp, Homo sapiens; identical to SEQ ID NO: 27884

SEQ ID NO: 27888 - DNA, 1953 bp, Homo sapiens
aagcatggtttattttctgagcaaggagtcatcatgggagaccttttttccttattttgggaggtagatcctcccccaatacctgtaaattgtgccattccaaatcaggattatgaatgctggaaggatgactcttgtggaaccatagggagcttcctgctttggtattttgttatcgtatttgtcctgatgttcttctctagggcttctgtctggatgtctgaggataaaaaggatgaaggcagtgggacaagtacttcagtaaggaaagcaagcaaagagacttcctgtaagcggcaaagcaaagacagtgcctgggatccctcacaaacaatgaagaaaccaaagcagaaccaacttacccctgtaaccaactcagaagtggctttggtcaatgcctatcctgaacaaagacgagccaggcgccagtctcagttcaatgaggtgaaccagaaccaacatgacagtgatactacggagtatggcagtgaagagtctaactcagaagcctcctcgtggaaggagagtgaaagtgaacaccacccatcaccagacagtattaagaggagaaaaatggctcagaggcaaaggaatctgggaagttaccaaatgagcgaaaggcactgcctccactgcaaagccttgagaaccaacgaatggttggcgcaccattcccgacagaagccttcagtaacaccgccaatgaaaagagacagtcaagaggaaagttccatatctgacattaacaagaaatttagtaaattttgaattttatcacgttcttccttcacttgaagccaaatgaaagagatgaataaaacatgaaaaatcaccagagctataggtgaggagacttttacaacaaagtctctctaccaacaaacaaaaacatacttggaacccaagaggtaaaatctcacacaattcttcgttcaaaaaaaaaggccatcacgtgtttatggcaccattggaacaccaaagatctatatctgctatgatttttttatttgaaatagcacaagacagatattttgtgccttgagtgtatatattttgtgccttgagtgtatgtattttgtttatgtctgtaatatgaataagaaagctctttgaaaatgtattatttatgttgagaaaccacttaaatgtattcagatgttttgcttatctgactgactgaatgaactaggtgaagttggttggaatagaattgccccatcctctctaggtttgaccctacaagaactgtattgccacacatgtcagctaggggctggtgtggaagaggagctcaagaggctggaataagatctgattcctggagtagggaggagaggcagcatgacccagaaggcagttggcagtgggctacccacggttgtcatccacaaagtgcatggcaaatgttaaaggaaaaattattctgacacttgttaaaatggccaggaggacttcattcaagactctattgcaatagagagtagaaattgagctccactctgaatacaacaaggacaagtggggatttatagccaggagcaggaggaggacatcacaggatgggaaattaccaaagagagacatcaaacataggagtattcctgataaagtgacctaacaggattcatgctaaaggcaggccaaggacttacacatcaaaagtggagaatgaggccaggcgtggtggctcatgcctgtaatcccggcactttgggaggccaaggcaggcggatcacctgaggtcaggaatttgagaccagcctggccaatgtggtgaaaccccacctctactaaaaatacaaaaattagccaggtgtggtggcacatgcctggagtcccagctactcgggaggctgaggcacaagaaaagcttgaacccaggaggtggaggttgcagtgagctgagattgtgccactgcactccagcctgggcaatagagtgagactctgttt

SEQ ID NO: 27889 - DNA, 3526 bp, Homo sapiens
atatagcgcaaagctgcggtatggagaaaagcctagaacccacagccgccatgatgacgcaaacaaaattaaaagggtcaagaactcaaggcccactgtttcacctaagaagaaaaggaagaagatgaaggggagaagagaagctctgatttgggtcaatatggaaaggggaggctgacgcaggctgcccaagagccagcctttagcttagtgacggtgatgcggatccgccatcttgaagcgccgcccggcagaggactctcaagacgccacagccccaccacggccacttctcccaaggtacaggtgcgcccgcattcactgaggtcggcctggcccacccctaccccaagaagcgaatcgcccttcattcaaggcaatgaccagcaagactatcacaaagagaaccacggtgaaaaatcccaaagggctttctgggccctgggaagatgtctgtcatctgggactagtgggaagaactcaaaaagtgaccctatttgccaagctcatctaataacacatacagctgttattttcttttcagactctaaaatgcaagggttcccagagccctgctgagttacctggtgtcgctcccatcctgatgcccgggcggtggccgccttctctgtccagccctccctgaaaatgaccccaggctaaggatcagctcagagccccgagctgtttttgtagctttcatgttgacagaacatcctggccactctgctgagagctccatctcccggctcccgatacactgagtcatcttccaaagaggaaaaaaaacaacaaagcagccgtcaccagggtccccattgccgtcgactgacgactcactggctgtcgtcacactctgctccgcggcccccgaattggtaacgaggggcttcagggtgcccagctcccctcccgtgggactcagcagcgtcagggaagcaggcagccactgctgagattcagaaagaagggaaactaacctggcatcaaaaggctcccaggaaagctcactgaccctccctctgccgtcaccagcccccaccactcagatgccatggcatgttcctgatgcagaagtaaaggggtatttatggcaggtgggggacagtacaccttgcaggcttgaagggcgtaacgcctaggttacctcctctgcgcccctgctgtgataccacttagggcacaggagctcctgtctcccccatttcttctctagccccctgctatgctcccattttaagtccctgataaaccactgggtagggatgggaacctatttgctgccaatatattaggcatttctgtataacagttgtagtagctccatctcactgaaaacttaaatcatatgacttgtctaaagtcactcagctaagaagaaggatcacaatgaaaacctaggtctgttcaagtccagtgtctctgctccctgctctctaattctggagcttattctggctttgaagatgctgtatcccactccacctctccctcctcttgtacgaggaaggcaaccaggataactgagtcagttaatccatcaatttcagctacaagaaaaaagccatcatcttgagtgaacctgaccacaaaggaagaggagaaagttaatgacagtgtcaaggaacagctgagggacccagaccatggacacaagattgaccacccaaactccctcagagcattagggacttacaaaattccttaaatagacaaattttggggatctacttcataacagccatcttgtaaacaccagtaattcagagaggaaaaatgtaaaggctttggaagaccagggctctagtcatgaccaggccacttactagacatgggatgctccccacagggctgtggaaaggagtaaatgaagtaactgcagggaaagtgtataacatggtatctgtcaaacagaaggcaccaaataggtatttgttttccttctcctttctctagcctccctcctggagctcccagtctgataggtgacataagacttatacacaaataatcataacacaacaaaagtaccataaaaagggacagactgtatggaagtttggctgaaagggcaggggtggttatgagaactgcttcttgccaaggaaatcaggagaggtccacggagaaagtgagactgccacaggtggatgcagaggagaagaggcatggaaaacatcactggtgaaaacagataggaaaaggaagttgcctggttttgttggaacctatggtccaccaaaagaaactgagagaggtaagactgtacaggaaacctaaggccagttacggccagcattgagcatcacgctaaagggaaggaattttactctgggaattatgagaaaccattttaagtttctgagcaagaaagacaagatggccgctgcacgcagaagggcctggagagagggggaacgggcagcggggagcctcacaagaggactacagctggaaccatggcactggcagggggcatggaggagaaagagaagaaaaacagtaagcaggcaggaccatccgaacagatcctcaaagctgccatggacctcacttccctgtccccacagggaggctgctggagacagagcctatttggggaacacaaaccacgggtctgacacgtctgagatgagctgccgagcctctgcctccactctcattcagacactcagcttttccgaactactccaagcaccaggctgatgaggacatgggaaacccacgctctggcaaagccgggcccaggtgttgaacccctacccagacgccttccacctgaatccccacccaggactgtgtccaagggtgggactaggcggctctgcccctagagccaccttcattgcggcagccaccactgtgcctgcctctgctgtgcttttgccccccctccccctccccacaaacgtgagacctgcgacagacaggttagagagccgggaccctgatttttcgaggcctccctcccccaaccaaaggcggacagcctgctgccctagttttattctgattctcctcattccctagactgacaaacctttctaacccggggcctccaaacctcccgtctcccactgacttttctggaaatcccaccagatgcggagtttcgagcaatttcctggggtcagtcccccatcctcacctttccaagcaccacgtagtagtagcttccagaaggtagatctttcccatactgggctcagctcacaactggctcttgagggcctctggacagccccggacgtcaatgcaaatctgttgtccccagggagtagcccagagtcagcaggaagcccagggtggtggcagtatcagcagcagcagctctgccctaccttgcccatgcgtttccaggggagccaagaattattttgccgcaacactgaggtgtggctgattggaaaattcccttttccaacaccaaactagagaataaatattttcttccaatttggtcaaccctctgcatacccatctccctagcattcttccctctaaataaaaagttttgggagccctg

SEQ ID NO: 27890 - DNA, 1859 bp, Homo sapiens
ggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacatgaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgcttcttttaatgaattatttcacatgacagaagaattttaaagtagaaatatgtggggactgtacagagaatccaggatttagtaaacatgtgatttcagtacagggcttttcttggactttttactccaaagttaatttaataaaaataatattaaatggaa

SEQ ID NO: 27891 - DNA, 3799 bp, Homo sapiens
gtgctggggacccacgcggcaccgcggggagggggctctgcgcgctcaaccccgtccctggcattatccgccgcctccacccgccggcctcccgcagcctggccagggccatgaggaccaagcaggtgaacttgctgatcaccctggtcgccgtcgcgttgttcagcttctcttgcttctccatctacaggataactcaaaccaagtaatgaagattatttacattctgttgttaaaatgattacaaaaaaattcaaaaggcaagtgaggtctggatccttagaggtcatttcaatacctgcctttttatactcaagcatgttaaatgccaagcacttagctgaggcctcacaaaaattagccaggattgggagagttggggcaatgtgtgctcacgcatttcatcagaggccaaacataaagtcactttgtgaagggagttaacattgggtttcttcaagaggaccatgaagagttccagagcttgtggagactactttcaaaataaaaacaaaaaaagccacctttcctttccaagtaaaccaagggttggcgaatcaaacaggtattggatttttgcattttgatgctgtatgcccaacccaaggccaagtattatttacagctagaagatgatatcatagctaaagagatgtactttacaaaaataacagattttgtaggtaatatcagttcaaataattggttttttattgagttttcaatgcttggattcataggtaagcaatggatttactttgttggatcaagttttttagcacacaataatttaaaacattttaaacagtttatcagtttgtttattactaaatgaaaaagaatggcatgatttttataaagacactattatcttaacagtataatcagatgcaagtacctaaattccagataatgtattttcttaaccaaacttttttctagagagatcaaattgacatttagacacataattcatagaaacataaaagagttaccatttattaaatgcttgctgtgagtctggcacacatgttagctgagtagctaagatgtacttttctctgctttacaagaatactgaaactcagataattaaaattgtagagaaagggactttaactcagtcgctgcaatttccagtatgctaaagctgacagtcttaaaaaatttaaaaacataataaaaattatacccaccacagaaaatttccaaatactatacccattatgagatcttttttactacccttccttagattttccttttaaatccttcaatttttctttcttcactgccatgcttttttctttcctttgaacctcaagtattaccatactgcttatattatggtgcatgacattattgattcatacaggagctcttccttatgtattctttccttttattcccaatccctacaccctcttcctgccactcttcaatatattgttcactctaatatgttcaaaatacacttataaatatacaatatccgtgtgaaatatttggtgcttttcatgtttgtatattcctattccttacatttttgtcctcaaaacttgatttctaaattatcagcatgttgttttatgttcatttagtttattggttttttactgctacataagtgctgcataatgatggtcactgaaatttatgcattcagaattgtgcaaagtgaggactacctgttttgcacatagagatcatgcatataaaactgtaacctgcttttaatttttttacgtcaacaatcccatgatcagctgtcttatagtcacatccaaattcacttccagcattcactgtctgtgctttcatctgtcatccagttctttcttttgattacctacttttgttaaatgtcatgtggatttatcatcagaaggcaaggcaaggcaaccacacgttttgctgtctacaagtgaactaaatactggatgcacagtgacccatcaccaaaagactttgaaagaagtgatgacttatcacttatcactcacatttggcttatctatttcctgagtggcagaccttaattgcttccaattttctgctgccatgaaaaaatgaagtgacatatatgtcccctggagtggaccactgaggattcacatagctctaagtactgccaattgctttacagattggttatacggtttacgctctcataagcagtgcgtaaaagttcgtgcttccccatatgcttgacaacacttggttttatctattattatatgtatatatttgccattctcagtataaagcatttctgggattgctagtgagatccatctgtttttcatatactcactcgatgacttttgtttttcatgttttctgtaaaattttaagggcccaaaggtttttcctcagccttggttaaaataagaaggaaaattattgttaacagtaatacccaaagtaaagcatgcagacaaagtaatcttgctgatggattagtctgagaatttaaaattctcaaaaaaatttatctttctcagcaaagtcaagtaagagacacatagagaatgcttacattctgatcacaagagcacattgaacaaggagcactatttatgggatgccaaatcttattcaagttttaacttacaaaagtttttcttttagttatcataatagcaattcggttattcattatttgctaaaaatatgagcttgccaactagaattttacagcatggtgacagcaggttaggaattgaatcagctattttatacatcattaaatcacttgctttggttactacataaataggtgcaaaaaattaaaaaattaaaatacaattatacattttattaagtgactcatataaacttaagttctagtgaagaatgaagcatgcttacatcctactttcatatttatcaaatcattagatatattttacattatttactttgaagtgaatatgtacctgaatcttatcccttcaacttcattttaaaattaaagatgcagtatataagaaaaaaactattagacctaatggaataatatttaaaaatatagtaaatctttaagaataacaaatataaaagaaaaataacatcctgttaaaataatgctcaaatactgaaatgagagtactttaataaaattaagtactaacaacgaaaaatgtagtagattgataaagtgctacaaaaatcaggtaaaaaatacagtttgtacaaaattaagtaaaagattacaacgcctatatatttcattctattcacttgtctttcacttgatttagacaatcaatcctcattagttatcacaattgatttcctgagagtattgactattctaaacctgcttatattctccttcagatgtggtaatccttaatacttaagcagatatagtgtttaattttatcattgtctaacttcagcaatgctttaatctttatttctaaggaatgggacatatttaaattttaataacttttgctttttcccatgttaaaggaatgaacaactacatatgaattatttgcatctaattgtatttttttccataggaaagctgtttagatctgaggacttaactcactttgtacggttttttttaatgttctacaaagagaaacccatagactggctcttgaatgacatttttcaggtaaaggtgtgtgacgcaggagaagatcttagaaactgtatgaaacgaaagaagcaaatacgtattcagtataaaccttctcttttccagcatgtgggtatacattcatcattccctagaaaagaacaatatgaaaaaaaaatatgaagaaaaaaaaaaaaaaaa

SEQ ID NO: 27892 - DNA, 4734 bp, Homo sapiens
atgtggccccaaccccgcttccctccccaccccgcgatgtcagaaaaaacacaacaggggaaattggccgcagccaagaaaaagttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggataggctacatgaacaggaggagaggctacgtgaacaggaggagaggctgtgtgaacaggaggagaggctacgtgaacatgaggagaggctgtgtgaacaggaggagaggctatgtgaacaggaggagaggctacgtgaacaggaggagaggctacatgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcagcaggaggagcaggagaggctgctggagagggagaggctgctggaagaggtggagaagctgttagaacaggagaggcggcaggaggagcaggagaggctgctggagagggagaggctgctggacgaggtggaggagctcctggatgaggtggaggagctcctggagcaggagaggcttcggcaacaggatgagaggctgtggcagcaggagactctgcaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaaggaattgaaaaaaaaaaacaaaacatttaaggggttaatatcctacacaattcatttacttcatttgaatgttagagccacttatgtttatttgtgtttctaatttatagtttaaatttatttgtgtttctaatttatagtttaaatttatttgtgtttctaatttatagtttaaatttatttgtgtttctaatttataatttaaatttatttgtaaaaagttaaatgagagtgggtgtttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcctgtatattcattacggaattcagataaaatttccttatgttctgctgttatgtttgatcgaatcctaatcacagtgagctcttcattagctcaatatgcagtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagcgttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgaataggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctctagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgcttctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacagaaattaaagttgtgggatgaaaaagttacaggataaaaaaatactgtggaaaagtggcaaaaaaaagttgtggaaaaaa

SEQ ID NO: 27893 - DNA, 5331 bp, Homo sapiens
acagctgcctggtaggtgactggaggcattgagcagtgctcactggtatttcgctgatgtggccccaaccccgcttccctccccaccccgcgatgtcagaaaaaacacaacaggggaaattggccgcagccaagaaaaagttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggtaagagtccagtggggtcccctgattacagctggtcaatcctggactccagtttcctcttggggccctgaagaaaggagctaggggcccctgatgccaagggcaaatggggagctgggcacccaggtctcacctggagggaccccagagcacagaacatgcagcatgggtcttctgcactgccctctttgctgactctctcttctccagacacccctgctctagtccttgccacacatgccctggggttgtcacctctctgggaagcactagcctgactggttgtcaggggtccatatttctgccctgcctcagtccctaatttgctttttgagtctggacaagccatctctcctctttatgctcgtgtttctggaggaggtagagagtatcaaaggtctcggttagctctgaaagtcagagatttaaaggcccctagaatggaaacctcagggccaagggctcctgtctgtcctttgctgttttatatctctgctatgaagaactgtacctggcctgtacatgctcagtaaatgtttattgaatgaatgcacgtttctaaatcacaaactggcagaaggggggtgggcccttctcaaactctgtctctggaggttcaccagcccctccctccagggcccttttccccctttgctttgggcaggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggataggctacatgaacaggaggagaggctacgtgaacaggaggagaggctgtgtgaacaggaggagaggctacgtgaacatgaggagaggctgtgtgaacaggaggagaggctatgtgaacaggaggagaggctacgtgaacaggaggagaggctacatgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctgctggaagaggtggagaagctgttagaacaggagaggcagcaggaggagcaggagaggctgctggagagggagaggctgctggaagaggtggagaagctgttagaacaggagaggcggcaggaggagcaggagaggctgctggagagggagaggctgctggacgagctcctggagcaggagaggcttcggcaacaggatgagaggctgtggcagcaggagactctgcaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaaggaattgaaaaaaaaaaacaaaacatttaaggggttaatatcctacacaattcatttacttcatttgaatgttagagccacttatgtttatttgtgtttctaatttatagtttaaatttatttgtgtttctaatttatagtttaaatttatttgtgtttctaatttatagtttaaatttatttgtgtttctaatttataatttaaatttatttgtaaaaagttaaatgagagtgggtgtttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcctgtatattcattacggaattcagataaaatttccttatgttctgctgttatgtttgatcgaatcctaatcacagtgagctcttcattagctcaatatgcagtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagcgttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgaataggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctctagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgcttctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacagaaattaaagttgtgggatgaaaaagttacaggataaaaaaatactgtggaaaagtggcaaaaaaaagttgtggaaaaaa

SEQ ID NO: 27894 - DNA, 5190 bp, Homo sapiens
gacatctttctgaagcatcattttcccttgattctcttgagaaaatgcattaatgtacttagggatgacagacacataggtttccaagcgtataccagacttcgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtttacttttctacctctgcccctggttttggtccctggaagctgctgattcatggcaaaaccccagagcttggagtcagaggactgagtttaagttccagtattgccttttttgatctttcttttttttttttttctatccatgatatcaatccctctcagtcactaagtgattgtgacaacaccttgtacagttgttggtggcattacatcagatggtatataagggtattttgtcaaaactgtaaaggaggatgtggctgtaggggctgatcattctcatgagtgttaccgctcttctttcccacagttaaaagcatattggcagaggaagagccctggcattccagcaggagctaacaggaaaaagaaaatcaatggcagtagccctgacacagccacttctggtggttaccactcacctggggatagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggataggctacatgaacaggaggagaggctacgtgaacaggaggagaggctgtgtgaacaggaggagaggctacgtgaacatgaggagaggctgtgtgaacaggaggagaggctatgtgaacaggaggagaggctacgtgaacaggaggagaggctacatgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcagcaggaggagcaggagaggctgctggagagggagaggctgctggaagaggtggagaagctgttagaacaggagaggcggcaggaggagcaggagaggctgctggagagggagaggctgctggacgaggtggaggagctcctggatgaggtggaggagctcctggagcaggagaggcttcggcaacaggatgagaggctgtggcagcaggagactctgcaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaaggaattgaaaaaaaaaaacaaaacatttaaggggttaatatcctacacaattcatttacttcatttgaatgttagagccacttatgtttatttgtgtttctaatttatagtttaaatttatttgtgtttctaatttatagtttaaatttatttgtgtttctaatttatagtttaaatttatttgtgtttctaatttataatttaaatttatttgtaaaaagttaaatgagagtgggtgtttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcctgtatattcattacggaattcagataaaatttccttatgttctgctgttatgtttgatcgaatcctaatcacagtgagctcttcattagctcaatatgcagtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagcgttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgaataggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctctagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgcttctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacagaaattaaagttgtgggatgaaaaagttacaggataaaaaaatactgtggaaaagtggcaaaaaaaagttgtggaaaaaa

SEQ ID NO: 27895 - DNA, 1638 bp, Homo sapiens
ctcagagtttgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccagggtcgtctaagtgagaggaaaagggagagggcggttgagaccaggccctgaattccgcgttcatcttatcctgaggtattcagtgccgagtgtggccttggtgctaggattcaaagaggaaaggaagaaaactttccattctaaaagaaactccacgtgaggcgaagaagatgaaatatagtcagaaaaccataccagtaggtggtagttaagttgataaatgatgcatacgacatcctatagaagactgtcaccaccccacctcactgatcagccctctgcctacagccacacccacagaacattcagccatttctcctgtggttcccagcctgcagcacagcgtctgcacgtggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagagtccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaa

SEQ ID NO: 27896 - DNA, 1638 bp, Homo sapiens; identical to SEQ ID NO: 27895

SEQ ID NO: 27897 - DNA, 1781 bp, Homo sapiens
ccagagcagcgcgcggggcagacctcctcgggtcctccggcgcttcggtctccggagacgcccggcctcctgaagggttcggcttgtcctcctctggcgctcagctccctctggcggccgggctggcaggacctcagcgcccagcccttccgtcttgttacgtccagggtctcactctgtgtctcaggctggagtacagtggtgcaattgtagatggctgcagccctcgacctcctgggctcaagtgatcctcctgccttagcctctcgagtagctgggagtacagatgcacaccaccacacccagcctagaatgaagaaacctgcagttgggaagcatgaatttaccacctattaaggcactggtttactgagacaattcaaaacacacattcattttgtgtgcttatgaaatatatcccaagatccccttttatttttcagaattgtggcttgcattgtaagaggagcctgtgaattcagaggcaagtctgctgaggaccgaatgttcctgtccataaaaacagaagtctggcctgggctcctctcttgggtgaatttgcaatgccagatcctctctatcagtttggttttgtttcttgtatctctgggaaggcaggcagacagcacggtcacctgtgaatgcagctacaattggcttagctgcctcactgataaatgtgcccccagtaagctacaaagggattaccagcgttctcagcagctaaaggaactggtgaagatttccccagcaaaaagtagaagctcagtgtttcatagatgaagactggggagattgcaaaagacccatccagagtctcactttgtcgcccaggctggagtacagtggtgcgatcttggctctctgcaacctctgcctcccaggttcaagtaattctcctgcctcagcctcccgagtagctggtactacaggcacacatttgtagagatggtgtttccccatgtcatccaggctggtctggaactcctgggatcaagtaatccacccgcctcggcctcccaaagtgctgggattacagacgtgagccaccacgccctgccaataaaaagattatctccagatgctgactaaggtacagagaggtcaagtaacttgcccaaagtcacacaactatcaaggagcagagctgaggtttgatgtcacagaggggtcaagatacagtcatatttattaaacagcctacttcatgctttgaacagaagagttttatcagttttaaatgtttcttcatttctataccttcttttatctgaggagcttaagccattttgtagaggcattaagtattgcctcagtcttaatatgtgagacaaggtgtgaggaatatagagattcataaaataatccccatcttcaaggaactcacagtcaggaagaacagagcctgcaacacaaataattgcaatatagtagaagtgccaataggagctctatgaagggcgtgaaacaggaaaggctacatagaggagatggcagacactctgtggattgtgacctgttggtgggccatgaaatcaatttgggggtttgagagcatcattcttttaataaaacagaagagaatcatctgcaataaggaacccatggatgaataccatctggtcctggtgatttactgcacagagtccctcaagttgctccatacctttctcctgagagactgaagaatctctgtcaaggccgttctctgctttgccataaaatgtgtccttggaacaagaatttccccattgtcttcttcaataaatactgattcaaag

SEQ ID NO: 27898 - DNA, 1781 bp, Homo sapiens
ccagagcagcgcgcggggcagacctcctcgggtcctccggcgcttcggtctccggagacgcccggcctcctgaagggttcggcttgtcctcctctggcgctcagctccctctggcggccgggctggcaggacctcagcgcccagcccttccgtcttgttacgtccagggtctcactctgtgtctcaggctggagtacagtggtgcaattgtagatggctgcagccctcgacctcctgggctcaagtgatcctcctgccttagcctctcgagtagctgggagtacagatgcacaccaccacacccagcctagaatgaagaaacctgcagttgggaagcatgaatttaccacctattaaggcactggtttactgagacaattcaaaacacacattcattttgtgtgcttatgaaatatatcctaagatccccttttatttttcagaattgtggcttgcattgtaagaggagcctgtgaattcagaggcaagtctgctgaggaccgaatgttcctgtccataaaaacagaagtctggcctgggctcctctcttgggtgaatttgcaatgccagatcctctctatcagtttggttttgtttcttgtatctctgggaaggcaggcagacagcacggtcacctgtgaatgcagctacaattggcttagctgcctcactgataaatgtgcccccagtaagctacaaagggattaccagcgttctcagcagctaaaggaactggtgaagatttccccagcaaaaagtagaagctcagtgtttcatagatgaagactggggagattgcaaaagacccatccagagtctcactttgtcgcccaggctggagtacagtggtgcgatcttggctctctgcaacctctgcctcccaggttcaagtaattctcctgcctcagcctcccgagtagctggtactacaggcacacatttgtagagatggtgtttccccatgtcatccaggctggtctggaactcctgggatcaagtaatccacccgcctcggcctcccaaagtgctgggattacagacgtgagccaccacgccctgccaataaaaagattatctccagatgctgactaaggtacagagaggtcaagtaacttgcccaaagtcacacaactatcaaggagcagagctgaggtttgatgtcacagaggggtcaagatacagtcatatttattaaacagcctacttcatgctttgaacagaagagttttatcagttttaaatgtttcttcatttctataccttcttttatctgaggagcttaagccattttgtagaggcattaagtattgcctcagtcttaatatgtgagacaaggtgtgaggaatatagagattcataaaataatccccatcttcaaggaactcacagtcaggaagaacagagcctgcaacacaaataattgcaatatagtagaagtgccaataggagctctatgaagggcgtgaaacaggaaaggctacatagaggagatggcagacactctgtggattgtgacctgttggtgggccatgaaatcaatttgggggtttgagagcatcattcttttaataaaacagaagagaatcatctgcaataaggaacccatggatgaataccatctggtcctggtgatttactgcacagagtccctcaagttgctccatacctttctcctgagagactgaagaatctctgtcaaggccgttctctgctttgccataaaatgtgtccttggaacaagaatttccccattgtcttcttcaataaatactgattcaaag

SEQ ID NO: 27899 - DNA, 649 bp, Homo sapiens
gaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatgagattgagtctcacattataaagcaagaagatatacttaatggcaaagagaatgagattaaagagttgcagcaagttatcagccagcagaaacagatcttcaggaatcacatgtctgacttccggatccagaagcagcaggagagctacatggcccaggtgctggaccagaagcataagaaagcctcagggacacgtcaggcccgcagccaccagcatcccagggaaaaataaaatggccgccgctttcctgttctctgg

SEQ ID NO: 27900 - DNA, 649 bp, Homo sapiens
gaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatgagattgagtctcacattataaagcaagaagatatacttaatggcaaagagaatgagattaaagagttgcagcaagttatcagccagcagaaacagatcttcaggaatcacatgtctgacttccggatccagaagcagcaggaaagctacatggcccaggtgctggaccagaagcataagaaagcctcagggacacgtcaggcccgcagccaccagcatcccagggaaaaataaaatggccgccgctttcctgttctctgg

SEQ ID NO: 27901 - DNA, 1037 bp, Homo sapiens
tgactcagggtagccaccgaacatgatgctcgggcagtgggtgccacctggactccactctcccctctctctgggatcatagagtccaaggtgttctgtggcctctcggccaatcccagcagctcagcgtgcagaagaccgaggagccattggaattcaacacaacacgaaataatcaacaaattcggggaatgttaatctgaccatcaccagttacaaatgatgtttcatgctaccttctattcctgccttcataaatcaaggaaaagaaaaagagaacatatatccccctaccttttgatttccaacagtctactgagaggccaagattatttgcagggaaagaaaaggggaatgccatccccaccctctcgcagctacgtgccagttccagagcacctgttcccctctactttgaaaaggtcaaaatgttttgccagtaactcccaaatcatctacagccaaggagaaaagtgtttcaagacagaggtgctcaatggtatcaaatactgccaacagaccaagtaatacatgcattgaagtgtctactggatctagctatatgaatttttaatttaggacacttaggccatactgaagcaaggtgacaaaatgaatagctacaatgtctcgtgaatcttgggtttccattcaccctggtattcaagagaaattcttgcatcatggaagttgcagttggataggactttctcagctgaacactgtcatctgccagagcttcaggcaagaacccagaacagatgaaaccccagacatgacaaaataagccaaagaataccaggccaaggtgtgaaaggccagatgagaacaagcagcgtacacgattctgttgccaacagatctcccctaacagtgtcgtgcaccaaatttccacagtgaatgtcaggaaaaaatggcaattgaggtgggtggtcaaaagagaagcacagtctatgatgaagtcaccccagagaagtcctttttccgttttctcctgagaaattaccagaagaaattaaaatccttttgagtattgc

SEQ ID NO: 27902 - DNA, 1032 bp, Homo sapiens
tgactcagggtagccaccgaacatgatgctcgggcagtgggtgccacctggactccactctcccctctctctgggatcatagagtccaaggtgttctgtggcctctcggccaatcccagcagctcagcgtgcagaagaccgaggagccattggaattcaacacaacacgaaataatcaacaaattcggggaatgttaatctgaccatcaccagttacaaatgatgtttcatgctaccttctattcctgccttcataaatcaaggaaaagaaaaagagaacatatatccccctaccttttgatttccaacagtctactgagaggccaagattatttgcagggaaagaaaaggggaatgccatccccaccctctcgcagctacgtgccagttccagagcacctgttcccctctactttgaaaaggtcaaaatgttttgccagtaactcccaaatcatctacagccaaggagaaaagtgtttcaagacagaggtgctcaatggtatcaaatactgccaacagaccaagtaatacatgcattgaagtgtctactggatctagctatatgaatttttaatttaggacacttaggccatactgaagcaaggtgacaaaatgaatagctacaatgtctcgtgaatcttgggtttccattcaccctggtattcaagagaaattcttgcatcatggaagttgcagttggataggactttctcagctgaacactgtcatctgccagagcttcaggcaagaacccagaacagatgaaaccccagacatgacaaaataagccaaagaataccaggccaaggtgtgaaaggccagatgagaacaagcagcgtacacgattctgttgccaacagatctcccctaacagtgtcgtgcaccaaatttccacagtgaatgtcaggaaaaaatggcaattgaggtgggtggtcaaaagagaagcacagtctatgatgaagtcaccccagagaagtcctttttccgttttctcctgagaaattaccagaagaaattaaaatccttttgagt

SEQ ID NO: 27903 - DNA, 565 bp, Homo sapiens
ccaacctggacgttccagaagaggccagggaggatctgagatggccttcttcaacttgtatctattgggatatcaaaattcctttcagaacaagaaaaggaacacaactgaagaaacaaaccagaaggaaccagagcctactaggcttccccccattatctcaaaagatgggaattattccgtgcaccagaatagccacacaagataccacgaagctgtccggaaggtgttgttgaagacgtttcccaatcaggtcttcagaatccccttgactgatgctcagaacttcagcttctggtggtcccatgatccaggagtgcgtccagaggaaaccatgccatggatccggagcccacgccattgtctcataaaaagcgcgatgaccaggtttatggatcactctattctcaatgacaggaccttcagtctgtattaagaagatatggctgcagaaagacaagatgaattgtggcaagagtgcagagggggaaagaaggaggtttcccagttccgatggctgactaatgggaggaggagatggagaaagcacagtaaacagactgga

SEQ ID NO: 27904 - DNA, 622 bp, Homo sapiens
ccagggaggatctgagatggccttcttcaacttgtatctattgggatatcaaaattcctttcagaacaagaaaaggaacacaactgaagaaacaaaaactttttgtttatccctagagttaagaattcctggcctccatggtagctcacgcctgtaatcccaggactttggaagcccgagaccagaaggaaccagagcctactaggcttccccccattatctcaaaagatgggaattattccgtgcaccagaatagccacacaagataccacgaagctgtccggaaggtgttgttgaagacgtttcccaatcaggtcttcagaatccccttgactgatgctcagaacttcagcttctggtggtcccatgatccaggagtgcgtccagaggaaaccatgccatggatccggagcccacgccattgtctcataaaaagcgcgatgaccaggtttatggatcactctattctcaatgacaggaccttcagtctgtattaagaagatatggctgcagaaagacaagatgaattgtggcaagagtgcagagggggaaagaaggaggtttcccagttccgatggctgactaatgggaggaggagatggagaaagcacagtaaacagac

SEQ ID NO: 27905 - DNA, 565 bp, Homo sapiens; identical to SEQ ID NO: 27903

SEQ ID NO: 27906 - DNA, 622 bp, Homo sapiens; identical to SEQ ID NO: 27904

SEQ ID NO: 27907 - DNA, 3823 bp, Homo sapiens
ttctgatttcttgtaaaaatattttgtatgtgtgaatgcatactgaatgtaaagtggataaaaaactcacacttgcactcatggaaggcttttcatgaatttgtcaatttttattttttatatttccccacttcaccagataatgcatacctgaacctggaaactgattcccactgcagaaagtgttctgagccacatcccttagcttcactagtgcaggtccacctgggaggatgtcccagcatcagcttgacccatgctgtgatcagccacctccatgcatcacaccaagcaagcccctgggtgattcacagtctccaccaccagggcactgaccttaactctgtgtttttctagctccccatgaggacaccgtacacgacatcactaacgaggacgccacacacgacatcgctaacgaggatactgtacacgacatcgctaacgaggccgccgacaagggcatcgccaacgaggatgccgcccagggcatcgccaacgaggacgccgcccagggcatcgccaaggaggacgccgcccagggcatcgccaaggaggacgccgcccagggcatcgctaacgaggccgccgacaagggcaccgccaacgaggatgccgcccacggcaccgccaacgaggacgccgcccacggcatcgccagcgaggacgccgcccacggaatcgccagcgaggacgccgcccacggcatcgccagcgaggacgccgcccagggcatcgccaacgaggacgccgcccagggcatcgccaaggaggacgccgtccacggcatcgccaacgaggacgccgcccagggcatcgccaaggaggacgccgcccagggcatcgccaacgaggacgccgcccagggcatcgccaaagaggacgccgcccagggcatcgccaaggaggacgccgcccagggcatcgccaacgagggcgccgcccagggcatcgccaaagaggacgccgcccacggcatcgccaacgaggacgccgcccagggcatcgccaacgaggacgccgcccacggaatcgccagcgaggacgccgcccagggcatcgccaacgaggacgccgcccacggaatcgccagcgaggacgccgtccagggcatcgacaaggaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggttgggggggggagggatagcatcgggagatatacctaatgctagatgatgagttagtgggtgcagcgcaccagcacggcacatgtatacatatgtaactaacctgcacaatgtgcacatgtaccctaaaacttaaagtatatatatataaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacaaggcacgctaacgaggatgctgtacacgacatcactaatgaggacagtgtacaagccatcactaatgaggacactgtatatggcatcgctaacgaggacactgtacaaggcattgctaacgagtacgctgtacacaacatcgctaatgaggacaccatataagacatcaccaatgaggatgctgtatatgacatcgctaatggcacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagctaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgagccattgacactggagaatgatacgtaccctgaaataactcacttcctgaggaaaaagcgccatctctagggtacagaaacctgattctgggctccttttgggaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactgctttccacgtaagatccaattggagagagttcccaggggccttcggggtatccatgctgcttgggaggttaagggagggggcatgaaatcaaaacgaaacaggaaatatgtgtcatattggatttggtcttttccgggtttattggcataatagttggaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttcctccaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatgacccac

SEQ ID NO: 27908 - DNA, 4731 bp, Homo sapiens
agtatttcctgtcacgaggaacattccgcaggaggaaatggaggctgaaaggctgcgactcctcgaggaagaggccaagctgaaaaaggtagccagaatgggatttaatgcatcttccatgctccgaaaaagccagctaggtttcctcaacgtcaccagttactcccgtttagccaacgagctgcgtgtgagctgcatggagcggaaaaaggtccaaattcggagcttggatccctcctctttggcgagcgaccgatttaacttcattctggcgagtaccaacagcgaccagctcttcgtagtgaaccaggtcgaagtcgaaggctccaagtacggcatcatcagtctgcgaactctgaagatcccttcgttccacgtgtacgtgctcagaaacctctacgtccccaaccggaaggtgaagtccctgtgctgggcctcgctgaaccagttggactctcacgttctgctgtgcttcgagggaatcacagatgctccaagctgtgcagtgctgctcccagcgtcgcggttcttaagtgttcacacaagagttaaccagcctggcatgctctgcagtttccagatcccagaggcctggtcctgtgcgtggtccctcaacacctgggcatatcactgctttagtgcaggcttgtctcagcaggtcctgttgaccagcgtggcgacgggacaccagcagtcatttgataccagcagtgatgtcttggcccagcagtttgctagtacggctcctttgctgtttaatggctgtcgctccggggagatctttgccattgatctgcgttgtagaaatcgaggcaaggggtggagggccactcgcctgttccatgactcagcagtgacctctgtgcaaatcctccaagaagagcaatgcctgatggcatcagacatgactggaaagatcaagctgtgggatctgagggccactaaatgtgtaaggcagtacgaaggtcacgtgaatgagtccgcctatctgcccctgcatgtgcacgaggaagagggaatcgtggtggcagtgggccaggactgctacacgagaatctggagcctccatgatgcccacctgctcagaaccatcccttccccgtactctgcctccgaggacgacattcccagcgtggccttcgcttctcggctcgggggcatccggggagcagcaccagggctgctcatggctgtccggcaggacctttattgtttccccttcagctaattctgcaggtggcagcgcggccgaatgtggatttgacttaaggaagttaagagtatcttattaccgtttctgtgagagcattttaagagacgtgttgtatgtagatcgcatccatccggctgccaggggtaaggtgttaagagttttatgtggagacgttcttgtaaagttatttcagttaaactgtggacttaacttgaaagtccttttcataaaaggtacctgtttcctcttgttgaatgccttagaacagttaaccacctccccaacccttttttttttttaaataattaagacttttctaaggactgaagattggcaaaaactaaaataaattaaagcagcttctttcactagtagccctttagagaagcataatgatggtactggtaagactgtttgactaatcatacagggtcccaggcatctgcgcttgaggaagccagtgggagtggagacaagggagaggtaatttctcggagtctctacagaaatatttaaggctggagtttggaatcattaaatttggccttctcaaactcaatagcagatctcttaaggttctccttttattgttatcatccataggcattggaaggaaagatggatctttttaaatactagaagttttaaacagtccttgatgtgcttttgttgaggtacctttcagaatgtaaggtacagcagcttcggtttctattatggtgacttgaagttcagattcaaggaattggctttgactttttgtaatctaggagcagcagtttgtgagagatttattaaaaatgttaaagagcctgtttttctactaagcaaggaagaaaaaaaacgtgtaataaggttagttgctacttcttaatagccaaagcctggaaatgatctgaatttcgaaaatgctaaaattcgtgatataatcatacaatcggatactgcataataatagaaaataaggcacacttgctatgtgaaacagtatggaccaatctcaacatgttgactgaaattaggtagaaatgagtacaaactgtatgattcaattctaaagttcaaaagcagtaaaaacttgtctatggtgattaaaggtagagtagtacgtacctctgtagaaagaaaggatttttttttctttttctttttaggatgtttgagaagtgacatggggaagctttaggaatgctgagttttctttatcttgacacttgatacatacgtaattcatatatctatatgcttcacgtttttatagtttactgtatatatgttattcctcaaaaaataaaaataagcaattaggacactattgtagttaggcaagggacaatgatgccttggacctgcatgtgtgagaagtagaaatgatcagaaatgattgcattggaagatcattcgaaggtagtattattgataaggcttgctgatgagagtaaactagaaagtgaaagaaaaaaggatggcagctttttttttttttttttttttgagacggagtctccttctgtcgcccaggctggagtgcagtggcgcgatctcggctcactgcaagctctgaggatggcagcttttttgttaactttagaactggtagatgatggtgtcgtttactaacctggggaggatgaggagaaaaaactttaggtgaagggaatgatgctgagttttagacatctactaaacctccaattggagatacaaagtattctgcagatcaggggtcatgtcatggctggtaatacaaatttggtgacttcaatacatagaattaaaatagatgggatagatgtgctttatatgacatagatgaggttaatgtaattacatattgatagaagatgagtagatcaatagagaagatatgggagtgtggttaggcacagatttttggaatcctttcagtcagttttttatactaacttgatatgtgacatgagaaattgtgtaagctttacttgctgttgtttcttcagtgtaaaatgtcttagataataaaactaaatgataaagtagatacagggttaaaggatatgtatcttgtcccttttacattgtaagcattcaaaataaaacaaaacaattaatgaagaaaagacattgcaatcattcagtaagaactagctgcagacatatatatgtatatatatatatgtctgatactgatatgtcatttatttggcaattgacaaaaaatgactacataacttgataaactgtttatcctcatttgcaaagaaaacaaatgcaaaaaaaaaatcagtaagaaaaacacacctaaaagaaagggaggcgatagtcttgaataggagaaaaagaggagatccaaatggctaatatacatttgaaaaggcatccaacttcttttattgtcaaggaaatgcaaattaaaaccacaatgccacaccactttcactataatggttaaaataaaatagatcaggtggagtgacgttgggaattaaaagagaagcaaatgttggtgcagttgtgagcaaatagaactttcatatactgttgagtgtatactggtacaagcacttggaaaagttagtaattgctaaagctagaagtttgcatactctatgacccagtcatttcagtcctaggaatatattaatcagaaatgcatacctgtgtccaccataatttgttaatagctccaactggaaactacccaaatgttcattaatagtagagtggataaattgtgggatattaacacaatggaatcctttttgcagtgagaatgagcatagcactatggacaaatcctgcaaacataatgttgaaataaagatgccaaacacaaaagagcacatattgtacaactaatgcacataaagtccctaaacaggcaaaatgaatctatgttcttagaagcaggattaatggtatacttgtaggacagaagagtagtgaccagaagaagattctaggaagctagcaatgctggtgtcatgccagacccctagtgactccaatagtaatggcactgtgtccgagagtccaaagaagatgcgtagacagcgaacaagacttgggtttattgggggaacttatatatagggatggtccagtggtagtaggctggacagaagaaccactactgtttgtaaaaagcatgcagtttatatagcattttcatttagcacactccacctagcaacctccatttaacccaaagcaaaggaccttgatcccctatattgcctgtgttgtaagggatgggctgggggttcagacgtcattcatagataaggagtgaaactcagggttagtcgctcctgtttccttagtttgggattctgagcacacattcgttttagatcacagggtcgttctcaggatatggttgttactgctgtcaggtgcatcctctctatagcggggtactggctacagtttttgttcactagtgataattgttagagctatgcccttaatatatgtcttgtgtgtattatacttcaataaaaagttaaattttaaaaaacccaaaaaaaaaaaaaaaa

SEQ ID NO: 27909 - DNA, 2726 bp, Homo sapiens
ttggttgggtaattttcattccaaataaacttatcacaaaaaaactcagcttcccaaggtcattcccccgctgccagatacatacttatctctgaaagagcttggaagatggacctttcaattcctctacaattagtagctgagttacagagtaacctgccagcaatcctatcagcattcatcagactatttaaatagagcaaagtccacaaaaaattccactgagacatgctgagcaaaggccggagccccagaagaaaacaagtacagactcagaggaaagctgccctggtcctgagtgtgactcccatggtccccgtggggtctgtgtggttggcaatgagctctgtgctgtcagctttcatgagggagctccctggctggttcctgttctttggggtcttcctccccgtgactttgctgctgctcctcctcatcgcctacttcaggatcaaactgattgaggttaatgaagaactgtcccagaactgtgatcgccaacataatcccaaggatggctcttccctgtaccagagaatgaaatggacgtgaagttggggactttccaataactaaagcacaatgagtttctactggtcagcaagcaatggccaacagttcagctaataaagtaggttgataaactagaaccatagcaaaatagaaagaatactaagatactcattctgaaccatactgaaaagtggcagctattatctaaggggacttctcagagactcagtataacagcagctcttgaaaagtaccaagaatggatttcctgggtatatacactggacacattgtaactttttaacttttattgtgactgtgtctgctctaaacggcatatttaaaaaataaaattctgcagcatcttactacataatcccataggaacccctattattccgattttagaggtgaagaaaccttggtagagatccaatgaatagcaaaagatgaatgccttggagagagctcagtagattccatatgcaagaatatttccacgttcttcttgcagttcagcaactcttaagtgacacagttcaggtatcatttttggacctgactttgcttctctccttttcctgattgctttcacaaatcattattgtcacaaatatgcacaaaacaagtggagtatccccacactaggtatggatcacccacaaatgtagctttcagcatgatgcgacctggaaatgttggcaatttggtaatgggaaaaggaaagggcagaatgttcacataattcctgaggaggagaatacaagtctttgcctgtaataccaaaatacagggagctatatctaactatgcggataagtcaacatttcactacagttctttttcagtgggagccccaaagagacaacataggtaattgaaaagaaacttaattctaggggtagttaaacgagattgtggttactgttgtgctccccacattcttccagttaacataaatcaaagatgttcaatgcattctaagtgtaagactggttacattccaatctttgtgcaggacattaacaggctgagtgatccactttataaaacataatgaatggggtcacctgtaagaaatgcacctgtttcagtagtggcttacagtcatactaaaggttgtgtggatgacccaaagcaaaaatataccatcagtgctggatttttactgcttcttcccctcagccccaccctaaaattcttgatacccattccgtgagtagtttccatttgcacttcttgcataatataaaacttattgctagaataaagacactcacttctgcattttactgcacttgattacaatgaaaatgtctgccggggttttcagactgaactaattcagagtaacagtgctcttgccatatggaaggaataacaatattctttcagttttgggagagatctctttttagcccctgggggaaatcagcttatgtaaaaatgctttctttaacagaaagtgtgaaaggacagatcgtattcctatctcaggcagctgccagccacatttgtggctcagctatcaaggtttgctccatcttcctccaataatgggcacttcagaaggccagttccagctctggtgggtgctggtccaccatctcagctattgtgataacacatgagctctatatagacatgttttcagcaccaagcactaccaagtactttagaacaaggcctgtttcttttctgccatccaatgagagcagagaatctccaatgaaactgactagatttatgaatgttttttatatgtagagaggggcagaaacatgttcattttcccatgaaggaacaagtcccaagggtttatcatctgcctgaaggcactgctaacgaatttgtcaaatcctttatccagcacagctttaccaagcagctgcacagtcaggcctttgcacttctcattctcataggtccagtttaagatctcattcagtcctgaactgcttcggtcctttgcattcctgctgtcttggcctccacctagaccaagtcggcagtctccctacattaccctacattcagctgcatcctatgctccaaggcctttcaccaggggccagaaatgctcccacaaccctcaatggtctcactacaacagttccgaatcttattccaaatgctatagtatctgaaacggttcaccaatagggataatgtttctccaactggagaccttcaataaaacacttcaataggtg

SEQ ID NO: 27910 - DNA, 2726 bp, Homo sapiens; identical to SEQ ID NO: 27909

SEQ ID NO: 27911 - DNA, 322 bp, Homo sapiens
tcgttttcatcacgaagaatatgtgctcagtaagaatcagaatgttcaattgtgtgaaggtgggagatgggaagattggtattatggcctggatccagaaatcagtcttccactataggaaatgggaatttaaagatgatcagaagacagttgggagcagagtgagaataagaaccctcaactgctgtctcacctttcagatcacgaagaagttttttacaatgagcagaacactcaacctgaaagcagaatggattgagtcactgcagcgtggcagtggaatggtgtttgatgttggcaaaggaaacatgtacttctagac

SEQ ID NO: 27912 - DNA, 823 bp, Homo sapiens
taaaggcatgacactgagattgaaggctagttctacttcagaaccacagagacatgagcaccagcaagtttgaggttggataaggatcttcagaactcctcagcttcagatggtcaagcactgcttcctcccttcttcaacggcatctctagcatgtatacttcccttaaatccaccttcgtagcatttgctgatggaagaggcacaacagagtccatgccttcacctcctctggccaactctaatcatgaatctcctgtgaatcagctgggaaacatgcagaatatgagattggggccctcattcatactaactggaattttccttggcaatggtagaacagaagcttctccattctttacagatgaatttgctttaagtaagatcttcccagagtacaaaagaaatttattcggaaaatttcaaactaatatggccttctcactggaactggatccaccatcccttttgctcagtgtcgtcttgtttatgttttagatcctttgcaaggtgagctacacctctgagaggagctcctggaaattaccagatacttaatgttgccagctgttacagatggaggtgatgcaccttgatgatgcataagtactgagcctgaatcctacaaatgggaaaaggtgctcatatcagacttatgcattagatatcaaactacaaaatacaagtgcagttgatacctgtttagatgatgtagagcaaggtaacagagtatgtattaaaagcaaaaattcccatgaagctgaaccgttactctctgccaaaacctcccactctcaagttttaagagccaataaaccttgta

SEQ ID NO: 27913 - DNA, 2836 bp, Homo sapiens
atgaacggcagcattggggacaaatgcagcaaggcagagagccccgacgcgccggggcaagtgacaggggtcacccagcagagctcgcggaaatgggaggcgccttctgggcgcgccctatggggctgctccgggaggtggccgccaggggggcgcagtgtctcggaacgcgaggaccgcggggccagctggcgttgccaggctcgccgccgtggccgttgccaggtgacccgccgctgtttaccgtggggcggagcggagcgccaggctcgctgtactcgcgcacccaccatggcctcccgcagcgcgggcaccctactgaccgagttcaatgccgcctacgtgccccctggactcatgcccggtggggcacagccagcagggcataagggacctcgcatggatgtagccggggaagggggaggagatggagccacgtggggtttagtgcttggagacgccccaggcgggcagcctccagcgcttagagaaaatgcgagaaaatcaggcccttccgtccggcgcacagggccagcacccagcattcgggcaaggtaccagggccacgtccccactgtggccttctcctttggcgctccctacggcaccaccaccctcaagtacttccaggaccaccgcaacagagccatggagaagagccacactcccttcagccaaggcggccatttccccaccatcttctccaccaaccccaacctcctgctgatggagcgcgccagcacccgggaccgctggctgcacaagcccagctacactcgcttcaacctggacagccatcgctccacagagcttacgaatttctaccagatggtccagcagcatcggaagtactatcaagacaagacgggcacagtgcctcgagtcccctactttgcgatgcccgtgagggagccggaacggtaccccctccccaccgtcctgtgagtgcctgccctcccttcatctacgcagtcaagaaacgcacccatggggcacctgctctcggccaggcatgcacagcacacagactgagaaatgagttgaggatcttgccctaaaacgtgcagtgcagagagtgatggttacagagcaagggggtcagggcattggcagcctcaggggggatggtggtagcctgaatgggcgaatcaggaagagtgctttcccggccagatgcactgggagtttgggagaagctccgtaagcttagtgggcctgaatctgcggactgatgccccgcctgcaaaggcagcctggcagctacactagtcctaacgtgggcgccgatgcagagcgcagtaaggagctgctgccctctggtggatacagagggcactacaccgagcaggaatctcccccggtcccgttcacatttggaaaatgttctcctaaggactttctgtccatctaactaaataggaaagttccttgcctcctgcccctctctgcttttatctaggagagctcctttctccagggaaggcccactctgccctgaaagatgacttgggtactgtggtttctgtgctctctccttcctgaagcgcaggcagggggatcattggctcacacgaggtgtcctggagtggggtagggtggtgggtggtgcctggcctgggaggtcagtggatagagcttgggatttagctccatgccaaccactcccggcttgcctcagagtcctaagattcaccatcatccttactgataaaacagcatctgttttcataagtttaatggtttttaaagaaacaggcttcactgcatctaaaagttcctttttgcaagtcagacaggatcattttacaaaaaagggaacgtgaggctcattgatcgcctggggaacttgtgctgcgtggcctggatggttggaggcagagcttggaaaggaagcagcatctcccatcaccacctctaggactcgggggctctctctaatcttggaatggctctgagccagtccatccctagagtatagtgggactctcctggggacaggtatcctcttgagatggctctggccaggatctgccccccatccccatcactgtggggagagcgggacatctcaactctgttccttcttcaggttgcctggccacttgcactgctgctgacagtttcacaacgaacgcaaagggccaaccaggtggttgggagaagagggtcagtgacaggcctggggcaagcccctccctcccggaatcccctccatcagcaccatcaccatttcttagaacatttgttgtgtgtttactccttgtccagagcttcacatgcattactgcatttattcctcaagtcaaagctaagagggggataccaccactgggccattcttaaatatgcacacttctagcaggagttaggaccagagtccgtcccaggtctgtctgacatctgtgtcctcactcttaaccactgtgccattatgtaaatacaggttattcccaccccaagtccagggggacttatcaggtgttaaactgacgagtagccggcaggtcagcttgagctggaaagtgggcacgtggggctgtgggtgggcacgcaccaccttccttccctggcacactgcataacaccagtcccatcctcacccctaggcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatg

SEQ ID NO: 27914 - DNA, 2836 bp, Homo sapiens; identical to SEQ ID NO: 27913

SEQ ID NO: 27915 - DNA, 1585 bp, Homo sapiens
tcattttgactcgtttggacaagtgagttactacagcgctgatttggaaaaatgactagaaagctacctccaatttctcggcctcaaccccagcctcattttctttctgttccttcccgctctcgtcttccagccctccttccccccgttactcctcaaacttcctgccgtcagcctcctctccagagccgtccaagttgttcgattttctgccctacccgtttgcccaagctgactaatgtcgccccttcccagtaccctacctcaaggaacttcctgcccggcccttcctctgttactaccagggcgtccgtgtgccgccgccctgttcgtcaggcacccctttcccggtgtccccctatctttccccctcaccctcctcatagcccttctttctagtcccctgtactctagtccccactccctatccagccacccccaaccagacctgacggcttgcaaatctcaccctggagaaatggtttccctcctactggggcagttcccaggcggtccagaattgccaggacttgtggattcccagcagcgacctggcagacacggggaatccaagaccatggcaagcgaacattcggcctggcctgcgcctttcctctcctgcctgggcagccagactgcacaagcctctgcatttgaactggcttctccgtggaacttggtttgtaaccacggagcaaactgcaggaccaggggcagagaagttgatggcgagcctttttcctggcagtatccagaggcggttctagtaaagaggctggattccgagaggccagagcggtatcatacgaacgccgttgcctggagacggagtggggtgccattgcctagagactgcagaaggcccgcagccaagcgagtggtaagaggacgccgagagagccccggacccacggagcagccccaaggctatggcgggacacccgaaagagagggtggtcacagatgaggtccatcagaaccagatcttgcgggagctgtacctcaaagagttacgaacccagaaactccacacgcagtaccatgtgaatcccctgcgcaaggttcacaggattacgaggaagcctatgtcttggcatgataacctggaggaacccgcagacgccaggtttctgaatctcattcaccatgctgcccaggggccaacgaagaagtacccggaggcacagactgaaaaccaggaaattgggtgggactcagaagccttggtcgacccagaacgccgtgaccacaggatgaaccacttcagggtctacagtgacatcactctgtacaaagctaaaatgtggagcttgggagaagatgatcgccacaagtagcatctcagctgtggagtcaggccctggatttaatgccctaaatatccactgcctagaagactaaacattattttaaccccccgtcccccatccataattcatggataatggcaaaaattaggaagcataaaaaatatgcggaagaaggaaataaaaattgcccattatctcaccatatggaagtgactaatgttagcattttaaaccatttgtttttaaaattaataataaattgcatatatttattg

SEQ ID NO: 27916 - DNA, 1585 bp, Homo sapiens
tcattttgactcgtttggacaagtgagttactacagcgctgatttggaaaaatgactagaaagctacctccaatttctcggcctcaaccccagcctcattttctttctgttccttcccgctctcgtcttccagccctccttccccccgttactcctcaaacttcctgccgtcagcctcctctccagagccgtccaagttgttcgattttctgccctacccgtttgcccaagctgactaatgtcgccccttcccagtaccctacctcaaggaacttcctgcccggcccttcctctgttactaccagggcgtccgtgtgccgccgccctgttcgtcaggcacccctttcccggtgtccccctatctttccccctcaccctcctcatagcccttctttctagtcccctgtactctagtccccactccctatccagccacccccaaccagacctgacggcttgcaaatctcaccctggagaaatggtttccctcctactggggcagttcccaggcggtccagaattgccaggacttgtggattcccagcagcgacctggcagacacggggaatccaagaccatggcaagcgaacattcggcctggcctgcgcctttcctctcctgcctgggcagccagactgcacaagcctctgcatttgaactggcttctccgtggaacttggtttgtaaccacggagcaaactgcaggaccaggggcagagaagttgatggcaagcctttttcctggcagtatccagaggcggttctagtaaagaggctggattccgagaggccagagcggtatcatacgaacgccgttgcctggagacggagtggggtgccattgcctagagactgcagaaggcccgcagccaagcgagtggtaagaggacgccgagagagccccggacccacggagcagccccaaggctatggcgggacacccgaaagagagggtggtcacagatgaggtccatcagaaccagatcttgcgggagctgtacctcaaagagttacgaacccagaaactccacacgcagtaccatgtgaatcccctgcgcaaggttcacaggattacgaggaagcctatgtcttggcatgataacctggaggaacccgcagacgccaggtttctgaatctcattcaccatgctgcccaggggccaacgaagaagtacccggaggcacagactgaaaaccaggaaattgggtgggactcagaagccttggtcgacccagaacgccgtgaccacaggatgaaccacttcagggtctacagtgacatcactctgtacaaagctaaaatgtggagcttgggagaagatgatcgccacaagtagcatctcagctgtggagtcaggccctggatttaatgccctaaatatccactgcctagaagactaaacattattttaaccccccgtcccccatccataattcatggataatggcaaaaattaggaagcataaaaaatatgcggaagaaggaaataaaaattgcccattatctcaccatatggaagtgactaatgttagcattttaaaccatttgtttttaaaattaataataaattgcatatatttattg

SEQ ID NO: 27917 - DNA, 1585 bp, Homo sapiens; identical to SEQ ID NO: 27916

SEQ ID NO: 27918 - DNA, 2286 bp, Homo sapiens
acatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacgtgagctgggatgaagatgagagcccagattcccgagtccttgagggaggaagggattgaaattctaaaacctcagttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccctaaaaaaaaaaaaaaaaaaaaaaaaaaaaaaaaaaaaaaaaaa

SEQ ID NO: 27919 - DNA, 2210 bp, Homo sapiens
acatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccctaaaaaaaaaaaaaaaaaaaaaaaaaaaaaaaaaaaaaaaaaa

SEQ ID NO: 27920 - DNA, 1651 bp, Homo sapiens
agtggacactgtcggcacggtgggctgggggcgtaagggccccggtggtcctagggaccccatggccatggttgagcggccgaggcccgagtgggcctcgtatcacaactgcaacagcaacagctgccaggacctgggcaactctgtcctgttgctgctgggcctcatcatctgcattaacattagcatcaatatagtgaccctggtcagggtggggccagatgggagggagctggtgggatagtggggggcaggcctgccggccagggcctacctgggatcactgtgtcttcccccacctagctctggagccgattccgtggtgtcttataccaagtgttccatgataccatttgtgagaaaggtaagaggtctgggggctgggacataggaggggcagaaaccaagtgctctagcctcagccctaaattagccccttcccttcttgctcgcccctctcagacaacatagctgtgtggctgcccttcctgggccctgcctctccatgcctgtaggagctggcctccccactagtctcacctctcccccatccacagaagctcccaagtcatcattactcagaaagcagacccagccccctaagaagcagagttctcctgcagtccatcttcggtgcaccatggaccctgtgatgatgactgtgtccccgcccccagctcaccgccatcgccgtcgaggctctcccacacgctgtgctcactgcccagtagcttgggctcctgacactgatgacgagaagcctcatcagtacccagccatctgctcctaccactgggatgtccctgaggactgggaaggcttccaacacactcaggggacctgggttccctggtctcaggatgccccagagtcccctccccagaccatccgcttccagcctgggcaacagagcgagactccatctcaaaaaaaaaaaaaaaaaaaaaagaagagaaatattggggcccccctcaagaggtacctcactgtaacatcacagctctctgtgacctcactcctttgattaactcaccatgtcaccagtgaggagactaagttcagagaagctaagggtcttgctcatggttacacagacactgaggatcaagctcatggcctcagatgctccatcccattgctgcagagccagcctgacccaccagaacctcccaccttccccagttcaccatgtgaactcagaaactgagaaacagagaaactcaggccctgcctttctgctacacaattgggatcatatgcacatgcacacacataccacttgagaacaagcagctgtgtgcgtgagcccaggctgagggagctggacttcaccttccactctagacagattcctggaatgtgagcagacggaccgtttacaaatggccctacttctctcattcaactaacgttactgatcattttcaatggattccattcagtggaatctgaatctactctgcatctactctgtgtttggaggctggatgggatatgatcactggcctttctttctgctgagtggttcactgtgtaaacaaatggcttgcagtctccagggcaccacagaccccagtgatgcacctgttttaagtcaaacactctttttggtatattaacaattacatgtattttgtgctttgttaatttc

SEQ ID NO: 27921 - DNA, 915 bp, Homo sapiens
atgcccaattctcagaacccagtgacctctcctttagagaacaaagggcctgggcattctggagactctgattggctgggcagatgggctgactggctgggcagatgggtgggtgagttccctctccccagagccatcggccaggtaccaaagctcagctgtatggattcccaacaggaggacctgcgcttccctgggatgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaggtcaggacccacctggatgtcatgctatgaaacattaaaagaaaaaa

SEQ ID NO: 27922 - DNA, 915 bp, Homo sapiens
atgcccaattctcagaacccagtgacctctcctttagagaacaaagggcctgggcattctggagactctgattggctgggcagatgggctgactggctgggcagatgggtgggtgagttccctctccccagagccatcggccaggtaccaaagctcagctgtatggattcccaacaggaggacctgcgcttccctgggatgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggagttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaggtcaggacccacctggatgtcatgctatgaaacattaaaagaaaaaa

SEQ ID NO: 27923 - DNA, 1150 bp, Homo sapiens
actgccgtccacggcttcattccttgaagccgtgagaccacgaacccttcgattgagaagaaccttcggtcggaagaagacttctcgtctcagtaacaataacaagaaaaacagcctagactagacgcacatcaggaagacagttaatcccgtcatgtattgacccggaaacatcatctcatttgcctataagacagagagagagaatgatagaaatgctggaagaacgagccttggggcggtatcgcccagatctgaatccacacagcagctgcttcggtccctgtaactcaaggcttcctcttaatcctctgtcctccatcaacacctggctgagcaggaacaactatgacctaggaccagggccttcaggaatcttcacccctaacttgaacttcataacactggagagagagactgtggaatggaatgactctccagagctgcagattgaaggcatattttcatctgactttgatctcaatggcgggaacaccttcatggcccctttatagctggtatgttttcttcttatggacaatgagaaacatgtaataaactgtgtttccttctcgctaggaaaccctgagttaaagctttacttccctctcaggaaccatcaaagagccataatctgtacaccctggtgcaacatttcccctggatttgatcccctttcaattgttttagccttattttacatttcttaaatctatttctctatgttgccatgtgtattatcaaatgctatttcagatgccaaccatgagctaaagcatatgttggaattattaagagaaacagagggatatacttatgtaaaataacacatataaatgcaatgctgattttttttccttaagaagtctttaacaattgcttcggaggaatctgcttttcactgaagcttcaatattttcagatcctttaataccaggtgtcaaacttattcactgggatgaattatagaaagttgcaccactttcttctgcctcatttattctcattgtaaatatgagaattttaaaaagtcttcctaattcttgctttatgatggattctatacaaacaattgaggtgctgttcactaaactactggaaacatggggaagtgagctaaggagataggaactatgaaatgacctgtttt

SEQ ID NO: 27924 - DNA, 483 bp, Homo sapiens
cagatgggtccagcagtgctgggtcaaggccaggaggggcagccggaagcgcgcgcatgctctggactcctgcagccgccgaaacggccaatcgtgtttaaggagaaactaacaatgaaaacggactcgttgatggaggaaaagttggaatgcagcctctggtgctgtttgagcgatccctctatcccgggtcgctgctgtgttctggaaaggcgcattgtaccctggatgcagcaggaatcctattcatcttcttcaccgatatggtctgtggactctgatgagccaaatctgacatcagttctggaacgtctagaagatactaaggagaacagttcggtgaggaaagaaaccaagctattttctcttttcctcatgaacattatatttagaaattaaatgttaagtgataatattatataaaaacatgattaacaactgtaatcttagaggaattaaagtctgggtattttaagtcctcca

SEQ ID NO: 27925 - DNA, 5122 bp, Homo sapiens
acagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaagaaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaaaaccagatggctgaacctctgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggtgaaggagacggagcgtctggaagctgccagccagcagaaacagcagctaacggcccagttgagcctcatggctctccctggggaaggacacggaggagaacatctggacagtgagggggaggaggcacctcggcccatgccgagtgtcccagaggacctggagagcagggaggccatgagcggctttatggaccacctggaggagaaggcagacctgagtgagctggtggagaaagaagaacttggattcttccagtactacagagagggatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaagtagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcgtgcatattgagtttgcccttacgtggtggggttcaaacacacaaagacccactatttgcacaaaactattcttgctggtttggaataggctgccatgtgtttttaatgttattgcagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcagttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtgggtttaaaatgcacttaaagtcctgtccttgccttttattttctgaacttgatgtttttgcattctttgagttcagtttaaagacaactacgagcatctgcaaccaatctgacaataatgtgttcatcaggtgcctatggattaaatcacatactggcatatttaagctgaatgtcaatctggaaaataaattgactatattaacagaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttggaatgaattttacc

SEQ ID NO: 27926 - DNA, 5109 bp, Homo sapiens
acagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaaaaccagatggctgaacctctgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggagcgtctggaagctgccagccagcagaaacagcagctaacggcccagttgagcctcatggctctccctggggaaggacacggaggagaacatctggacagtgagggggaggaggcacctcggcccatgccgagtgtcccagaggacctggagagcagggaggccatgagcggctttatggaccacctggaggagaaggcagacctgagtgagctggtggagaaagaagaacttggattcttccagtactacagagagggatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaagtagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcgtgcatattgagtttgcccttacgtggtggggttcaaacacacaaagacccactatttgcacaaaactattcttgctggtttggaataggctgccatgtgtttttaatgttattgcagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcagttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtgggtttaaaatgcacttaaagtcctgtccttgccttttattttctgaacttgatgtttttgcattctttgagttcagtttaaagacaactacgagcatctgcaaccaatctgacaataatgtgttcatcaggtgcctatggattaaatcacatactggcatatttaagctgaatgtcaatctggaaaataaattgactatattaacagaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttggaatgaattttac

SEQ ID NO: 27927 - DNA, 912 bp, Homo sapiens
ctctgccaaggcgcctatgagagcctcttggcttttacctggtctgcgagaaatcaaactttgggcacaagtcatgaagccgacaagcccgggagacacagtgtcagaattacaaggtgagatcagccgcccggccaagctatcttctcgctagcagatgaagctgctttggtggaaggtgctaaaaagctgggctttgtacagtgagaacaccatattcggtcatcatagaagcaatagagctttggagccaaacccttctgatgatccaagggcaagcacagtcttcttgcaaaaatctcaaacagatggtatctactaagcattttactaaaaagtacagctcgtgttcaaccatatacctagatgacagcacagccagccagcctcatcttacaatcatagtaaaatcgaatgagcttgaaagacagtttttgcagctaattgactataacgtcgaagtttctggaagtgtttatgccaagtactattttgatcttcgatccttggcaaaggacaatagcttgcattttccagtttatcttctcaacaaagaaagggcacagaacctggaagctatttcaaggatggaagacgccaaaatcttttatagtgaaggtccttcagcgctgataatttcattaatcttcagcgctctaaagccattaactcttgaaggaagaaatgaggggctatatcatgtgaacccctcatcaaaaaagttcggaaaatattacctctcatgctcaacaactagaaaagttagtattttcaaaagaagaaaaatctcaaagttgagaggcttgtgggcaactaggattgcactccacaggaaaaaaatgggatcgttgcagtgcaacaactctcgtacactcttctgtctttttaaacgtaaacaggtataaaaactac

SEQ ID NO: 27928 - DNA, 912 bp, Homo sapiens; identical to SEQ ID NO: 27927

SEQ ID NO: 27929 - DNA, 1427 bp, Homo sapiens
atgagccagcgcatctggccaccttattttctattactggctcaatgtaatggctccatctcaggaacagccaatgaaagagatgcacaggacaaggggtgctacaagttgaccactgcagcagtaaagatgactctgaagaatggcatgggatggatcctttcgaatgcacttgagcagcagtctccaaccacagggccacagagctggaggcccatcccctgcctgtcggcggcctctacaggcccggcctctacctcacagtgggctctccaggcccacctcttcctcaccgtggcctcctggggcaatgctcctccctctcgggagcctctgcgggcccagctcctgcctcccagtggcctctgtagaccaagcccgtgcctcagggcagcctttccaggcctagcgtttgctgctttgcatcctctccaggccctggacttcctccagtcggcctctccaggcccagctcttcctctcggcggcctctgcagggccagactgtcgtcaagtcggcctgtccagggccagctcctgcctcccggcggcctctgcaggcccaagtcgttctcaagtcggcttccccaggcccagctccggcctcttggcggcctctccgggtttgtgtgcagaacatcctgcccatgttgccccagcagcttcagttggcacctgccccagtccagcctctgggaaccatgcagcggctcccagtggccctgcacccaccaccagcatccgtttcacctgcagttgaagatcagtgaggtgcccagaagatcatgcagtcatcagtcccacagagcagcccgcgaggctgaggctcctcccactggaccgtcacccaactggcaccactgctgcccctgcccctactctcagcctgacgtgactctcgggcagagacagtggtggggcagccagggcagcgtcaagagtctgagccagctgcaggacaagttcgagcatcttaaaatgattcaacaggaggagataaggaagctcgaggaagagaaaaaacaactggaaagagaaatcatagatttttataaaatgaaagctgcctctgaagcactgcagactcagctgagcactgatacaaagaaagacaaacatcctgatccatatgaattcctcttattaagaaaaataaagcatccaggattcaatgaagaactatcaccttgttaatcattcagaaacatgttgcagacttaagccatttttgatatagatactgaaacaattacttgctaagagcaaacttgaaggtatggataaggccctgagtcatcttcctgagctgaatgatagttaagctgaattaacaatttggacaagacagcaaatgctattgtcaaagttttctaaagaagaatctgaagtgaaatgacatcaagagacctatcaagacctgtatccag

SEQ ID NO: 27930 - DNA, 791 bp, Homo sapiens
atgccgacggagcgcattcttaatctatatggcaagaactacaagccacaggaccaatccccaccctccccacagagggacagtggcctgacacctgagagggatcggcccgattggccacgctccttcaaaccaccactttcccccgaaaaagggacgaaagcctcaggtccccaaacgagcgctccctcgcccagagaccccggcttgcacaccccgccctgttccccgcggcgcgggaggagaggccgccccacacaggaagtgtgtcctgcgccgggaccttgcgcccaacccgccggtacctgccctccgcccccaacaggcgagaagcagccgcgtccacatggcttcaggtgttcacatggcagtaaacgggcccctgctctcctgggcgccccagcgcggcgccctcccgcccacatcccggcccagccccgctggcctcgcctccagcccgtagccaagaggcgagcgcggccggtgcccccggggctgccaggggccccgaagcaggcggcgctgactcccggacgccgcccgctcacacccgccgcctttgcacccaaggcctcgcgcgaccagcagatggggccactgaggtgcaaagagtttaacttatcccaagtcacacagtttggaagaggctgagctggtatttgaacccaggttttcagaggctgcactcttaaccaccaagcttcccagcactcagcaaacactggaaagacagagatggacctagacagtcagtaggaccaaaagtctgcaggccgatagggaaagaatgt

SEQ ID NO: 27931 - DNA, 791 bp, Homo sapiens; identical to SEQ ID NO: 27930

SEQ ID NO: 27932 - DNA, 1258 bp, Homo sapiens
tcttccgcggccgcggtgggaatggaaacatctgccccacgtgcaggaagccgggtggtggccacgacagcgcgccactccgcagcgtaacctcgcagatcccctgcgtgtgtcctcgcaagactagctcaccgaaatggccgcgtccagtcaaggaaactttgagggagatattgagtcagtggaccttgcagaatttgctaagcagcagccgtggtggcgtaagctgtttgggccagaatctggactctcagccgaaaagtatagcgtggcaacccacctgttcattggaggtgtcactggatggtgcacgggttttatattccagaaggttggaaagttggctgcaacagctgtgggaggtggattttttctccttcagcttgcaaaccattctgggtacatcaaagttgattggcaacgagtggagaaggacatgaagaaagccaaagagcagctgaagatccctaagagcactcagatacctaaccaggtcaggagcaaagctgaggaggtggtgtcatttgtgaagaaaaatgttctagtgactgggggatttttcggaggctttctgcttggcatggcatcctaaagaagatacctcattttcattgttcctggttttttccagccagcagcctctacactccatcacaggacattgagtccctcctcctcttctcccatgccttcctccctgctgtggcaaatccgagtggcttctataagcatccgttggtacaagttaatgtggcaccatgagcctgactggcttctataagcatctgttggcacaagttaatgtggcaccatgagcttgatggcggcagaagagacaatagtccttagctcttcttccagtacgccccctacttagtcagtctgtaggtcatcaagaaggtccctctacccctatgcaagacacttacaagaacacattgcaagatagctgaccgtggaggatgagtggatcctgaaatgttgtcccgaactgttgatttggaaaagaaataagcacatagataaccttattgtgtgctgcatggaaaggaactgaacacaattgcctttaagcattaaaaaaaaaaggatgaaaaattggggtgtcacatttgcaaaatggatggacaaatgtggtcagggcagatcaaggaagtaccttccactctgagagtcagaatgctctgcatgtgtgctaaggcattaaatgaagattgaaagtcaaaaaaaaaaaaaaaaaagaaaaaaaaaaaaaaaa

SEQ ID NO: 27933 - DNA, 958 bp, Homo sapiens
atgcggccctcacccctactagggaagcagaaggagggagcatcccgtccaaagcttcccaagcggcgccggactgcgtgctgcggctgtgggggtagaagtcttcagataaaagatggggaaaacagaccaaagcaagtctcgctggccagtgacactccaggagcatggcccatggaaggatccaaggctgagggatctggggtagccccacagagatactctgccaaaatccagtcacgagaaggagggaggaggcgaggaacgaaaatgagatttggtttaggccggaagaacgggctgcgccaacaacgagaaaataaagtggcgagctgggaagggcgagagcgcgcagcagcccacagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttcctgccgtcgctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagttccttcctg

SEQ ID NO: 27934 - DNA, 6122 bp, Homo sapiens
aggcctagcactgggagtcattaggcaccagaaccctgaatgccgagatagagggatggctgatctcatgctaatgaggtttagaccatgttgagccctacttttgttctgtgggatgttggatatcccttatacacctatggctccatcttcatcgttattgtaattatctggcaagtgaaaaggagccaccatgaattgaacttggaagttgaaaggagctgctgctggcgtcaccaaaaagtcaggcaaagagctagagatgcagcatcaacagctaggagactttctcaggaagaagatcagaagccacaagagctgttctctgtcatgaaaagccagggctggcttcccccagagggaagtgtgcggcgaatcctatgtacagatccctgttgccaaatttgcaatgctatggctctggagattcagcagttgctggcggatgagaatgactagatctccccaactttgtcgaggagtccatcacaggtctcctcttgcctagagatcttgtctctgtctagtgtatcctttgagcagagtatagagctccattccagaaatatcagagagctttcactggcatctataaacccaacactgtcacaattaacagatcagaaatctttaacccagtcagctgcccagtcaacgtatgcagatggcatacaagattactgggctgatcacctccagctagggccggaatttcaagtgccagctgtgctccggggcccaaacaccatagcttcttcaaggcttgacaagccaagggctccactgaaccaggaggagatgagcagagcaaccccagccttgtccagggaaaccaaggccagcatcacttgaatttccaggtctccttgctgtccctgaacccagaaaccctgaaccggatgcatccgatggccttgcatatggtcctccctgcccacctgccatttctcagtcctgaagtgctgaggcttcttgaggtacatgttaaaaaatggatgcatttccagaggtgggggctcccaagacgtgtggaggagtccctgaggcagcttatgccaaacccaccattgtattaccaacctggaaatgaccagccagtttctttcaacctgaataatacttctcaggtctctcttcacagatctgagaccatttccctccagacctggtgttcatgtgtggctggccagcccatccagaccttctgggtttctgaatggtccacaatgaacccagaacaaagacaccactgtcagcaaactccaaaccctatggctctagccttgccctctccagcccttaaagccctaagtggcccccatccacagtctgggggacaagataatgactcagggagtgatctccagcagaaatacagccagctattctgtgggctcccttctctgcacagtgagtccctggttgccactttcatgggatctcaaggcctccccaagattgaaaatgtgcccaagccccccttgaaggatccttttctcttcaatgagctctccttcccccaactgctccctaaaacttcaccccagtcagccccaccctcttccccactttccccaaactgggtgtctccatctgaccatcaacgagctcagatcaatgtcccatttctgactctggctgagtatgaagccttggagtggcacctgctacagaggcaactccagcttcagtggggctggccagctgccctccagaggtctcagcacacccagtgcctcatgcagcatgagccctgtggcaaagctcagtctcctgagaccacgacagcttcccagacagggaagtccatctcagtgctcaccagggaactactcttcttcccggagcatgcccggaagctgctggaattccacatccagaaacagtcgattcgccatcgctggggcctgcctcagaagatccagcagtccatccagttgctccttacctccactgaccagcagactgtgtccagcagcagcacagccctagccaacgtgagcatcccccagcctgtagccctagaggccaacggggcttgcgatgtgctgtcacccattgcggccccagtgtccatccccaggccacacttgttaactcaggtcaaggcaatactgcagagccacatcgactccaaatgtggacaaatccaccagggcaagatccccgcctgtgtacacaggtcctgggactgcagaatttctggggtcctggcagtggctccttttccctgcattccagaaagccagttcctggtactgcagacagcaagtgacccagacctgcatcacaaagttatgccctggatgccaacggcccttgatcagcagcaacaggccttaccaggtactgtcactgaacaccctaagctgctccgagtcttgtctgtggaagccattgagaaactggagacaactttacggcacaagcatctggccttcctgtcggggctgcctgctctgtattatgtggcgctccccagggccctggccccggcagtcactagccaatctgtcatcacagagatggagcctagtcccgtggaaatcccagcagagcctctgatttagatggtttcatttgaagaacagtgtataagtcttgggccatgccctcaaggcaacaatgagagttgtacagacgttgcaaaagagttccagcctgcagtgccagtaaaaggaacaatggagacgctgcctctagaaagccagacgcatcctactagcccccactcactccagacacatatcttgaccaaactaaacttccacctgagaaaaaaggtcctagagatacaatggggaattcccattagggcaaggaagtccagggaacaaactgctgcagcaccagagaacatatccacacagaagtctcttgaaagtctaaaccaccaaggggagacattgctccaggaactgcccatcccaccagacactcttcctgcccctaatccagaaggggttcaccttaaagaacagctggccaatgacttgaaggcagtgcagcagaaccaaaagcaatccaattccaaagctgtaccccagggttctgcccactcggtctccaagatctcacaacccagtggggacatgacagaggcccacatgccttgtgttcaggtagaggccagtgtgaacaaccccagcctggaggaaccctgtggccctgagcctcaaagccctagcaagagcaaggacccagcccatgtccccatgctagcaggaaacagagaggacccagaggaaaccaaagcagccagggactacagagaaggggatgcggggtttgggcgctcctcaaccagagaagagagacgccctgctgaagaccagaggccagcagggatgcttccaaacaagacaccccgagggtcctggcgatggagccgtagctttcatcttgctgatccctgtcaacacagcccccagcatcaccctcagtttaagctcccacagctacctccacgagtccctggggagaaagagtctgagaaggacctgcaagacagtcaaaccaagctaactgtcatccttgaaccagcaacaattcctgagaatacccagactgtggtgccccagcttcacagggtcagcctttcctgagccaaccaactcaggctaagcctttgcagggccaaactttgcaatgccaagttttacatgggctggtgatgccagcccatactcaaaagaagcccagccttacagagtctagcttcagaaataaaattaaatgttttctggagtgtattaaccccaagacaaaaggcaaagggcacaaggattccatgttctctgccactgtgaaggtggccaaaaccagaaaagaaaatgttgcaaagagcctggctccagccaagagccctgtggggagaagtaagacagagaagccgacagggtgctccaaggcccaatctcatcgtgctcagaagctgatgggcccagctttcttggatggtccccagtccctagacaataagcttcggttacactccagacaacctggctctgcctcaaccccaggccacccccaccactgtcctcgtcactgtcctcgagtggcttgtgccccccaaccagggcacccaccctagctcctaaccctcagttcagatagaaacattggtctgctcaaggagaacacacagagccatgaaaaagagtttataggctccccaactgctgcagccctccagaggaccagtattttcatttccataaatatgctggtggggcagggtgccactagaaatgcactctatatgtttcagcaatacgttgcccatctgctccttatctccactgtattgtgttaagggaaggtgtgagggaggctaaaaagaccttcctgtctagggaaggagctttaacccacaattcagatggttcattttagaggagtgccacagtattccctccttgaggaggtgcttttgtgtttatcaaaacacaatatctaataagacagatgtcagatccagatgatagactctcctctgacttctccctgtttatactgggaagatctttctagaaaatccatcttggagcctgctgtaatcctgctgcctgtttactgcctccactgcctctcagttgcatgaaatgaaagcctcctggaatgagatgacagtagaaaatggagaagggcctgtcccacaggcccagggattggtagggagcagggtcacgtagttggaggtcagagtacctgtgacaaaagttgattctcatgcctgaccaggacatgagaatagagaaaagacagtttgcttggtgctaaaatgagcctagagccaggaggcaaacccaaggcccaagtgctttgggagggatcactgagcttagttctgcttgcccttagtgtgatgaagggcagggtgttgagcactgaagtttctgggaaagaaccacaaatataagaggttttctaaacatatgtgagcctgtcaagttactgccagcagcttgtacccaggcctactgtttctataccacctgtgcctggagcccttctccaccactctccttgccatgatccttactccttaaatttatcttcacagtaactaatggtgggcacccagtcagctgaatcccctcccaggatctacctggtgccttttcctcaggggatgactcctacactttttcctgccaaggacggcaccacagaagcctggcagctccagcccttggttcctgtcacccttctacatctcttcattgtgtcccactgcatttctgaaaacactgaagccaatcaccttggctgtcaaaagaagacaaggcttttggaaagtgtcctattaacacagaaagtgaccacaaatctacaatttaatgccacacatgagtctaacaatgagatcagctgctcataactgaggtggtgggactctggcccttttgcctctctctgggaatgtccaatattttgctattcagggaaatacatagttattattaattgaaatactatgtggaattctctgaaacctttggaatgaaatgaagtccaagagggaggctgagtggcaagctgagatctacaaggagctgctaagaaatgtaagcccctctcagtgatatcctattcacattctccctcacacacagattaaacaaagtccctcctacagacctgctttgggaggtctctcagtgtagcttgccataccaagatgttcctagagttctttcctgctaccttttcggtcgagcctcccaccccaatcccagcaccatcactgggtgagtgatccaccaccaaaggcagctttggtaatcctagccacacatcaagcctcttaataatggccatcatactcatattccttcgaacctctaaggagacctaaggggaccttgtccttccttctccagttacttgggttaaggcaggcactagtctccctggaacgcctgacctcttaaggagccatggcagaacggcatagctcaaggttgtgcttgctccactcaataggttaaatatgagtaaaagatttgggtcacccccttccctctggaaatttctggctgaagtgaccaaagaatgattttaaggcaaaatgataaacatgaacaaagggcaataaaacagcacaaagaaaatat

SEQ ID NO: 27935 - DNA, 2740 bp, Homo sapiens
tctggttgagatgaaaagtcaatggaggattttcatcaaaagagtgacataatatggcttatatttaaatataactactttacctgctatattaagaatggactgaagttaagtcaacaggaaaaaacaggaagaccaattacaggaggctttttgcatcaatacaggtcctggccatgccatcggcaacctgctcgtcttgtccgtgaggccttcccagctggccgggctcaccctgcagctcctgcacctgtgcctgcccggggaattgtgggccgtttcccactcctcttcaaccgtcagcgacatcttgggccttcttttccagtcaggtgggacggcgcccctatgaggctgtgtcttatccctcggaacacgggcaccccacagagggtcctgcgtcctgtggtctggagccccccctcaaggaagaaacccgtgctgtctcctcacaactccataatgtttggacacctcagccccgtaaggatcccttgtctcagaggcaagtttaaccttcaacttccttcattagatgatcaggtgatcccagccaggctcccgaagacggaggtgagcgcagaagagcccaaagaagcaacagaggtgaaagaccaggtagagacccaggggcaggaggacaataaaaggggcccctgtagcaatggggaagcagcctccacctctaggcccctggagactcagggaaacctcacttcttcctggtacaatcccaggcccttggagggaaatgtccacctcaagagcttgacagaaaagaatcagactgacaaggcccaggtgcatgcagtgagtttctactccaagggccatggagtcgccagttcacacagccctgctggaggcatccttccctttgggaagcctgacccacttccaacagtgctccctgccccagttccgggctgctccctgtggccagagaaggcggccttgaaggtgctgggtgaagaccacctgcccagctctccaggcttgctgatggtgggggaggacatgcagcccaaggatcctgcagctcttggatcaagtaggtcttctccacccagagctgccggccacaggtcccacaaaagaaaactgtcggggccaccgctgcagctgcaaccgacccctcccctgcaactgaggtgtgatagagacgagcggcccccaccggcaaagcttccatgtctatctcctgaggcactgttggtgggtcaggcttcccaaagagaaggacgcctccagcatggcaacatgcgtaagaacatgagagtgttaagtagaatatcaaaattcaggagactaagacagttgcttaggaggagaaagaagacacggcagggcaggcgtggtggctcatgcctgtaatccagcactttgggaggcccaggcgggcggatcaggagatcaagagattgagacctgaggagcatctctgcctgcaccatctgggaagtgaggagcgcctctgccctgctgctccaccatctgggaagtgaggagcgcctgtgcccggccaccgcaccatctgggcagtgaggagcgcctctgcccggcccccgccctgtctgggaagcgacaagagcctctgcccagcagcctcacagtctgggaagtgaggagcgcctctgcccaggccctgccccgtctgggcagtgaggagtgcctccgccaggccgccgccctgtctgggaagtgaggagcgcctctgcccagccaccgtcccgtctgcgaagcgaggagtgcctctgcccggcccccctacactctgggaagcgaggagtgcctctgcccggcccccctacactctgggaagtgaggagcgcctctgctcggccaccgccccgtccgggaagtgaggcgcgcctctgcccagccgcccactatctgggaattgaggaggagcgccgcctctgcctggcctccaccccatctgggaagtgaggagcacctctgcccagctgcctcacagtatgggaagtgagaagcgcctctgcccagccgccgccccatctgggaaacaaggagcgcctctgccccgccgccgtcctgtctgcgaagtaaggagtgcccctgcccggcctcctcaccgtgtgggaaatgaggagcgcctctgccccgccgccgccccgtctgcgaagcgaggagtgcctctgcccagcctcctcaccgtctgggaaatgaggagcgcctctgccctgccgccgtcccgtctgcgaagcgaggagtgcctctgcccggcctcctcaccgtctgggaaatgaggagtgcccctgccttgccgccgtcccgtctgcgaagcgaggagtgcctctgcccggcctcctcaccgtctgggaaatgaggagcgcctctgccctgctgccgtcctgtctgtgaagtgaggagtgcctctgcctggcctcctcaccgtctgggaaatgaggagcgcctctgcccggccaccgtcccatctgggaagtgaggagcgcccctgcccagccgccgccctgtctggaaagtgaggagcacctctgcccagccccctcaccatttgtaagggaggagtgcctctgcccagcccctgcaccgtctgggaagtgaggagtgcccccacccggccccctcaccatctgggaagtgaggagggtctctgcctggctgctgtgcaaccttccaagtgtgaagtgacagccttgtgtgtgatctttctgccctccccaggtttgcattttcgacattaaagtttactttt

SEQ ID NO: 27936 - DNA, 2740 bp, Homo sapiens; identical to SEQ ID NO: 27935

SEQ ID NO: 27937 - DNA, 1277 bp, Homo sapiens
aaaaagaggaaggccttactccgttccaaactgaaaggattaaatggcttcacctgggagaagataaccatcctgccctccattgctacccccacatactgtccatgttctcagggggtactgtgagtcctgggatctttggggttgcccacctgcctgtggtagttatggagacccccaggtgttgaggcagggctggggtgtccccttccaaccaggctgtcaaggccccaactctggggcagaggcagtggcagggcagccagggttgtgccagagcctgagcaggttgaggtggggtcaggcagggctgggagtcagggcaggggcagcagcagtggacccgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcttcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaatgtacgtataaaatatgattttctaaccacttgctcgccaacaaggaaaacttttaagtagagcagaacctgaatagacaagacatttctttcttttggtagaaaatgatttaccatcactgtgtagttaattgtagactaggtaattttaactttgtgatttattgccggagacattttcttctgtactgtaaagtg

SEQ ID NO: 27938 - DNA, 1484 bp, Homo sapiens
aaaaagaggaaggccttactccgttccaaactgaaaggattaaatggcttcacctgggagaagataaccatcctgccctccattgctacccccacatactgtccatgttctcagggggtactgtgagtcctgggatctttggggttgcccacctgcctgtggtagttatggagacccccaggtgttgaggcagggctggggtgtccccttccaaccaggctgtcaaggccccaactctggggcagaggcagtggcagggcagccagggttgtgccagagcctgagcaggttgaggtggggtcaggcagggctgggagtcagggcaggggcagcagcagtggacccgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcttcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaaggtttatatgtggaagagacttgccctgtctcaggaattagagaaagaacaaatcagtgtgaaggagaattgtcagtaaaattacaagaaaagattgagatcataattgacctttgaggataataaaatttaaagaccaaaaggatggacttcacagaaacatgaccttaggttgtttttgcagttgtagtaactggttatatgaccaacaaaatatgaagaatgggtacaaattctgatagtaatgatcagtcactttgcaaatataaagttactatttactactgtattgtacaggtt

SEQ ID NO: 27939 - DNA, 1311 bp, Homo sapiens
aaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtggtagttatggagacccccaggtgttgaggcagggctggggtgtccccttccaaccaggctgtcaaggccccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccctagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagggctggactcttggtctgtcgtccaggatagagggcagggatgccatcactactcactataacctcaaactcctgggctcaagcaatcctcccacctcagcctccggagtagctgggactacaggc

SEQ ID NO: 27940 - DNA, 1277 bp, Homo sapiens
aaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtggtagttatggagacccccaggtgttgaggcagggctggggtgtccccttccaaccaggctgtcaaggccccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccctagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaatgtacgtataaaatatgattttctaaccacttgctcgccaacaaggaaaacttttaagtagagcagaacctgaatagacaagacatttctttcttttggtagaaaatgatttaccatcactgtgtagttaattgtagactaggtaattttaactttgtgatttattgccggagacattttcttctgtactgtaaagtg

SEQ ID NO: 27941 - DNA, 1486 bp, Homo sapiens
aaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtggtagttatggagacccccaggtgttgaggcagggctggggtgtccccttccaaccaggctgtcaaggccccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccctagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaaggtttatatgtggaagagacttgccctgtctcaggaattagagaaagaactaatcagtgtgaaggagaattgtcagtaaaattacaagaaaagattgagatcataattgacctttgaggataataaaatttaaagaccaaaaggatggacttcacagaaacatgaccttaggttgtttttgcagttgtagtaactggttatatgaccaacaaaatatgaagaatgggtaaacaaattctgatagtaatgatcagtcactttgcaaatataaagttactatttactactgtattgtacaggtt

SEQ ID NO: 27942 - DNA, 2272 bp, Homo sapiens
tccagccacggccgggccagactcgtggacacaggcgcagtgtcacgtacagaccacggggagacatggcactaggggacaaatggacgtgacaccacaatgcacagggcaggccacagagctcgagggacgtgggcaggggccttttggcatttctgcgctggaatcatgtgagacaagggtggtggccgctctggaggtgcctggggggttccctcattacccctctgggcttagtccatcctccacactgttgtgcagcttctccacctcctggtagaggataaatactgttacccttatccctggtcacatccagggagacgcggtccagcggcccaggcgggggacagtgccgttctagaggtccttgagcccctccttcctcaggatctgcagccataggccggtgtgttccgcgtttgtgctgctccaggccccgcatccggtctcgatcccatccagaggagcgtttcccaagacactggctgcgcccacaatggctccgaagaccccagcgaccagcgggtccatgggcttgctggggttgtcccctcggtaccagctgtgcagggaggtcaggaggagaagcagacggcctggttccagccctgctttagcgtgggtgccatgaggccccggtgagtccccttgttctcgcacaatctctctaacctggtgggagactcctctgcactggaggtctgggaaggtctggccgtggatgaacttcaccttgatggtgtccatggaacatacgaccaccatggcctcggccacgccagcgccctggccgcaccgcagccagcgctgccgtcaggccgtccctgggcatcccgcgtctggctgctgtggaactggaacattcagaacccaacgccgccctggagacaagagccgcagagcagggagccgaggccgcggtgccggcccgggacgccatgaccgcgacagtgcgcacgcgggatccatgcgcggtgcccggctggtgccagcgctcgtccggctgcagctacgacctcccgcgctccgtggggagcggacgcccatttcaatgccgccggccaggccgcctgctggtgtcgccttccccggagcctccgctgggccttcccggacgcggcgcggcgtggccacggcgggcgggaggcgggcgcccgctgtgatctgaagtcccagcctcctaaactccgcactgggaccttaatttggttttaacacaaatgaagatctcactaaagataaaaagggatgtcttggcttctaatttttgttaaaagcaatagcatatgttgtataggatagtgcattggggtaaatcttttttttattatttttattttttcatcagcccactgacattgaaaggggataggttttaggttattgacgagcagttttctctcagataactgccttagtataggggtttgtggtcatgttgatgagagggtaggctggggttaaaagtcgttatggcagtaacaaccttctgaggaccaggaaattcaaatccctctcatgatactttgctaatatctcccgagtttgctgtgccttccctttgtgcctcttcccacacgtggtttcttgcacttggcccagctatattccactgttttgactccatgcttcttagcctggtggcagtggtgagggagtgaggagatctctaatgttctgaggaagcctcagacttagcactgtgaactggggtgtggggttactgaccgttgaagagtttcctgcccatcctgtacatgcaatgccaggacaagagcacattcctgtccctccttgtccatggtaggggaaacgtgctccttctccatgctcttaactcccagttgaagtgggccttgaacagtgccctgtaaattaatggtttcttttctttatgggagatgcatctgtgcagaaatgcgggtgttggccttgttccttcaccctcagttccatgagcttttccccagtgccctttggctcaggtttggatgctctttctctgcagattaggcctcatgttatataggagagatgtgagggctgtgtctccagagttgcagtagtggatgggatagtggtccctccccatcagcactgtgggacgtttaaagtattgctgtgtgtttcaagtggaggaggtcatattacaactgacatttgtccttgactactggacatatcacaccagccctgattgcagttatacttgaagccagatctacccttaacgtatattcattttactattcaataaatattaacttat

SEQ ID NO: 27943 - DNA, 3243 bp, Homo sapiens
ataggatccggtttattctgccttggcagggtgatcctgagagtggtgggtgtcaccctctcctgggcagagggaggggccgtgggccagtcaagccaatggtaggagaagcgctggtgaggggtggaatttggggttcaggggtgtaaccccaagaatgcagtgaaaccaggccgaggcccagaggcagctgtggtaggccagggcagggtggaaggcagtggactgggcccgggccgggatgacagggccaaggactcaggccacactggcaccccgggaggcggggcgcagtgtcgcatgacgtagaaaatgaatcacaggcccagggctcacaataagcacatggacaagtgggcacagactcacaggccagatggacctccagccacggccgggccagactcgtggacacaggcgcagtgtcacgtacagaccacggggagacatggcactaggggacaaatggacgtgacaccacaatgcacagggcaggccacagagctcgagggacgtgggcaggggccttttggcatttctgcgctggaatcatgtgagacaagggtggtggccgctctggaggtgcctggggggttccctcattacccctctgggcttagtccatcctccacactgttgtgcagcttctccacctcctggtagaggataaatactgttacccttatccctggtcacatccagggagacgcggtccagcggcccaggcgggggacagtgccgttctagaggtccttgagcccctccttcctcaggatctgcagccataggccggtgtgttccgcgtttgtgctgctccaggccccgcatccggtctcgatcccatccagaggagcgtttcccaagacactggctgcgcccacaatggctccgaagaccccagcgaccagcgggtccatgggcttgctggggttgtcccctcggtaccagctgtgcagggaggtcaggaggagaagcagacggcctggttccagccctgctttagcgtgggtgccatgaggccccggtgagtccccttgttctcgcacaatctctctaacctggtgggagactcctctgcactggaggtctgggaaggtctggccgtggatgaacttcaccttgatggtgtccatggaacatacgaccaccatggcctcggccacgccagcgccctggccgcaccgcagccagcgctgccgtcaggccgtccctgggcatcccgcgtctggctgctgtggaactggaacattcagaacccaacgccgccctggagacaagagccgcagagcagggagccgaggccgcggtgccggcccgggacgccatgaccgcgacagtgcgcacgcgggatccatgcgcggtgcccggctggtgccagcgctcgtccggctgcagctacgacctcccgcgctccgtggggagcggacgcccatttcaatgccgccggccaggccgcctgctggtgtcgccttccccggagcctccgctgggccttcccggacgcggcgcggcgtggccacggcgggcgggaggcgggcgcccgctgtgatctgaagtcccagcctcctaaactccgcactgggaccttaatttggttttaacacaaatgaagatctcactaaagataaaaagggatgtcttggcttctaatttttgttaaaagcaatagcatatgttgtataggatagtgcattggggtaaatcttttttttattatttttattttttcatcagcccactgacattgaaaggggataggttttaggttattgacgagcagttttctctcagataactgccttagtataggggtttgtggtcatgttgatgagagggtaggctggggttaaaagtcgttatggcagtaacaaccttctgaggaccaggaaattcaaatccctctcatgatactttgctaatatctcccgagtttgctgtgccttccctttgtgcctcttcccacacgtggtttcttgcacttggcccagctatattccactgttttgactccatgcttcttagcctggtggcagtggtgagggagtgaggagatctctaatgttctgaggaagcctcagacttagcactgtgaactggggtgtggggttactgaccgttgaagagtttcctgcccatcctgtacatgcaatgccaggacaagagcacattcctgtccctccttgtccatggtaggggaaacgtgctccttctccatgctcttaactcccagttgaagtgggccttgaacagtgccctgtaaattaatggtttcttttctttatgggagatgcatctgtgcagaaatgcgggtgttggccttgttccttcaccctcagttccatgagcttttccccagtgccctttggctcaggtttggatgctctttctctgcagattaggcctcatgttatataggagagatgtgagggctgtgtctccagagttgcagtagtggatgggatagtggtccctccccatcagcactgtggggtaagcatcctcaggattctaaccccatcttccctgacaggccttgtagggttcctagaaaaattatacacaacggtataaaccctacgtctgtagactccagggtttctcattctcctcacccacccacacacagccaccaggaactagttcaaaagttctggcttaattttaccagtttacatggtcttcagggtacacataaaagcctggagcctgtgtgacctgcaggctttctgcatcccctgatgttgggtttgtagtctgccctgtgacctcagttctttaaagggctcaggagaaaccatccattcatttgaagtttctccagcatttttgtttgtttgtttaatgtgtaggagcaactctttgtcaggtctctatatctacaaacttaactcagaaactaatatttttaaatatatttcttttctatcatacttttagtgctcctctacctatgctaattgttcttcagtattttttatatttgtatgtctttatctattttaaaatcaggtttaattccttcttaatcaaattaataacttttcatttatttccctacgtaactttcttttcagacgtttaaagtattgctgtgtgtttcaagtggaggaggtcatattacaactgacatttgtccttgactactggacatatcacaccagccctgattgcagttatacttgaagccagatctacccttaacgtatattcattttactattcaataaatattaacttatcatg

SEQ ID NO: 27944 - DNA, 3243 bp, Homo sapiens; identical to SEQ ID NO: 27943

SEQ ID NO: 27945 - DNA, 2272 bp, Homo sapiens; identical to SEQ ID NO: 27942

SEQ ID NO: 27946 - DNA, 3243 bp, Homo sapiens; identical to SEQ ID NO: 27943

SEQ ID NO: 27947 - DNA, 2272 bp, Homo sapiens; identical to SEQ ID NO: 27942

SEQ ID NO: 27948 - DNA, 1163 bp, Homo sapiens
aagggagctggatgccgggagggactggagccagcaaggccagagtgaaagcaaaatgacaactactcagaaacacgatctcttcacgccggagcctcactatgtccctggctatgccggcttctttccgcagctgcgctaccaggtggggaacacctatgggcgtaccacggggcagctgctcacagaccccagtgtgcagaagagcccctgctctgtgctgtcccccatgtccaaacccaagttcattgaggacttcagccagtccaagcccccgagggttccctgccaagacctgacggagccctacatcccccactacaccagtctgaagccctctaagaactttgagattctgggccagctcccacccttggaggtggacgcccaggagccgccaggggtagagaacatacccagacagattctgctgcctgcaggcttcacgcccgacaccccgcaccctccgtgcccaccaggcaggaagggagactccagagacttgggacacccagtatacggggaagaggcctggaagagcgccactcctgtttgcgaggcccccaggcagcaccagctgtaccactgccagagggatgagtacccaccccccgcccgccgccagcaggagacgctagatgtgggcagcttccagcggctgccgcagctggaccaccctaacctaatccaacgcaaggccatctcaggctatgctggcttcattccccgtttcacctgggtaatggggttgaattaccgagacggcgtcatgcaagccatggacgaattcgacaagagccagttcctgtttagaaacccccactgtgacctgggcgagaagctgcctggaacacactggcccagcaaccacatctacagcagccaaggcctgatccccttctacatggggttcatccccgccatgcaggacaactacgccctgacattcggcaacagcacccggagggcctactggaaggaatgggcaaagcgaaaccacacactatgaaaatgctttaatggtggtgtctgtacagcatggatgtggacagggaaaacagcaagtgcacacagtgggacaggccacaggacaggctgggagtgaataaagagttcacactgctaaaaaaaaaaaaaaaaaaaaaaaaaaaaaaaaaaaaaaa

SEQ ID NO: 27949 - DNA, 777 bp, Homo sapiens
atgtacatttatagaaaacattcatttcttactctccatcagataattcaatatggagagaaaccctatgaatgtaagcaatgtggaaggcctttggtcgtcatacagaccttagagtacatcaagaatgtgggaaggcctgtgattgccaggaatgtgggaagtcatcatacagaccttagaatccacaaaagaattcacactggtgagaaaccctatcaatgtgaagactgtgggacaacctttagtcgtcttacagaccttagagaatgtgggaaggccttcagtcaagcctcaaacctggcacaacatgacagaattcatactggtgaaaaaccctacaaatgtaaagaatgtgggaacgcctttagtcacacgtcacatcttgttagacgtgaaagaattcatactggtgagaaaccccgtgaatgtaaagagtgtgggaaagcttttaggagtaaccatcaacttactatacatcatagatttcatactggggagaaaccctatgaatgtaaggagtgtgggaaggcttttagtgtgtatggacgactgagtcagcatgagagtattcacagtggtgagagaccctttcaatgtaacaaatgtggaaagtcctttaggctcagttcaagtctcaaagtacatcagagcatgcatactggtgagaaaccctttgaatgtgacaaatgtgggaagtcctttaggtttagttcaatccttcaagtatatcacagaattcataccagtgaaatactttatggcatatacatataa

SEQ ID NO: 27950 - DNA, 1626 bp, Homo sapiens
atggcaatctggaaaaggggcaatctgagcagagaaagcagccagtgtcaaggctctgagcagccagaatggctggactggagtgtggctatgagaagaattggagtttatatgctgatgggaatgatccattcgaaaggggaaaatgatgaaacaggaaagagagaaacactcctggtgaggggtgctcatgtagaagaaaggcttgtaaaaaatactgcaattgatcatgggaagcatgagagtgtaggaggcttacgtttcttcttggctctgtgtggcctgaacgcaagggacgctatgatggaagacgttggacagaatccactggatgatgtcctggaaagaaagctggccttgtcactagaagaagccaaagaggaggaggagttgaactatgtcatagatgaacaggaggaatccctgagggagctggaattagagacagcaaagctggagaaaagtaacgcaatcctaagcaggaatgtggtggaggttcagaaaaagatttcagggttatttacaaatattggccttgaagaagaaaccacaaagcagatcctggaggaaatgaaggcaagactacagaagtcaacagagtcctgtgcaaagcaagaggaggaactggccaaggcagaggcaatgtctcttccactgaggcttttcacacagtttggaaatttgaatgtcctcttttgtgacatgtctttcgcctgcatctgtgagatggagaggaccaccattaagaaacaggagagaaggtgttggtacaagtatttccagtatctcaccttcatggtcttagtctttattaggttgctggcttatgtgattttccacctgcagtacataaacccagatcttctcgtggatgtcctgcccctggtgctgagcaggggcaccttggagaacctggaggttggcttgtatgaagtggataaacagggccccctgctgtcagttgagtttatccatggtggagcacaaacaccagggatgcagcctggtggcttttgtgactcagcaaatgacccgtggacaaagcggcacaccaagcccgtcttgccagctagtgacaaagatcgccattttgatgccattaagtatttttcagggaatttgggggtgcttctgaggctgcggtttcaagaagtcagtagtgtgaaaactggatccctatatgacaattttcagcacttacgatcaagaacggctaggctgagggggcaggggggccaggccactggagcgaaacggcctctccggatctggaggcgtgggaacctcgggaatagtggggagttccagaccagttcccttcccccatctgaacaagtccagagcgtgcgccttgagaggcgctcggaaacagggaagctggggacacgtagcgagagactggttgtcgccctggctctcgtcaggccggcgcgtgctaggaaggcggggcctgtggcctgtggggcggagcctcggtggaggtcggcgcagctgcccctttgggctttggctctggactggagcgcagcatccttcgaggctgcagccgccacggctgttgccgtgtcagagctgatgcaaatggggtatggtagtcttcaggttccttatagcactacatcttag

SEQ ID NO: 27951 - DNA, 676 bp, Homo sapiens
atcgcatcgtggcgagcaggaggcaggagcgggacgcgcaggggagccgggaccctcccgcgcacacgcacatgcacacgctgcgcgctctcacgcgcatacacacgccctccctgccgcgctcgccgccgcggccaccatcgcggagccgagccctgcggagcgggaaccgaggccggagcggggaccggaggcagccgagccgggggatgccggcccggagcggagccgcgcgcggacggcgcgcccgggacgcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgttt

SEQ ID NO: 27952 - DNA, 3232 bp, Homo sapiens
gatcttacaacccagtcccctaagttttctcaccccatttctggttcctctggttgcagcacaaatttccagctggaaggggagtggagactatgggacctaggagcaagagttaaaagcatattggcagaggaagagccctggcattccagcaggagctaacaggaaaaagaaaatcaatggcagtagccctgacacattcacttctggtggttaccactcacctggggatagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaagatggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttttgtttctaatttataatttaaatttatttgtaaaaagttaaatgagagtgggtctttctctcatgttcactctggcatcttttagcatttctttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttatcattctgaaactgagcttacctaatacattgataaattatttcaaaggtatttttatagttcaaatcgcttcacttttaccctgacacgtataaatgactaggaatgaccttcagatagcatttagcaactgtaaccaatctgacaataatgtgttcatcaggtacctgtggattaaatcacatactggcatatttaagctgaatgtcagtctgaaaaataaatgtactatattaactcaaaaaaaaaaaaaaaa

SEQ ID NO: 27953 - DNA, 750 bp, Homo sapiens
tccaagggttttatagcgtccggtagcgacacggagccggctcccccttttccagccttcctccccatctcccattctccatcccccacgacctataccagaggtccttaggcctccacgtctctccttttgccgagtagcccaaggtttccacccatctgccagggggatggcgtccactccgatggggaatgagggggagaagaagagcagctggccatctcaagctgcaccctccttgagaggaggtccggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcgcattcttcaccaagacctgaggcacagacacctggtgagtgaggcttcaagggagatgctctttgtcctgggagagagccctctcccctctcttccaccatctcctgctcggacagaaaccgtacctgcagcaaggcatacctcctgccaactcctggtgaaaagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgc

SEQ ID NO: 27954 - DNA, 678 bp, Homo sapiens
ggagccggctcccccttttccagccttcctccccatctcccattctccatcccccacgacctataccagaggtccttaggcctccacgtctctccttttgccgagtagcccaaggtttccacccatctgccagggggatggcgtccactccgatggggaatgagggggagaagaagagcagctggccatctcaagctgcaccctccttgagaggaggtccggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcgcattcttcaccaagacctgaggcacagacacctggtgagtgaggcttcaagggagatgctctttgtcctgggagagagaaaccgtacctgcagcaaggcatacctcctgccaactcctggtgaaaagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgt

SEQ ID NO: 27955 - DNA, 1997 bp, Homo sapiens
gcgcggtggcagacaggacttgttccacagtggtaactgggatagagctgatgtggccccaaccccacctcccttcccgccctgccatgtcggaagaaacccgacgagcaaattggcagcagcaaagaaaaagttgagagactatcagtggaggaacagccctggtgttcctacaggagtgaaaaagaaaattaaaaattgcagtaaccccgagacaaccacttctggtggttgccactcacctggagatgtaatggaggcatgtagacaaatacaactggagagagatacatttgctgagattcttaaaggagagagagccacatggcagcagaggatgaatcagatgtcggagcagatgcacacactgagggaggagaaggagtgtattatgaatcggttacaggagctggagacaagcttggtggaattgagaaaacagatgactgaactcccagccctggcacccccagcaaggccctccgaggtggagcagcagctacaagaggaggctgagcacctgagggaggagctggagagtctggcaggacagctccaagcccaggagcacctggaagctgccagccagagaaccagcagctacaggcccagctgagcctcatggctctccctgaggaaggtacgggagatcactcagaggaagaggagggagcccaggaggaaggggggactgttagcagataggagtgaggagtttagaacagctggtcactatgccgaccgggtttctgcgttaagttcggcatcaaaacggtgacctgggagtagaggggccaccaggttgcctaaggatgggtgaactggcccaagtcagaaatgaagcaggtcagaactcccctgccgggcagtagtggaactgagcttgggcaacatagtgcgactttggttctcaaaaaaaaaataaaaataaattacagctgctcattcccctctggagagggactggcccagggttatacagtgacggttgaggcagaggtgggcccaccctacttcccttgttgggtcgcgtgaggacccctctagctctgtgccctaggaggtagactggacggagggtgggggagaaggaggggcgggggggggaggaggaggaggatgaggatgaggaggagaaggagaaggagaagaagaagaagaagaaggaggagaaggagaaggaggaggaggcgtctcggcccatgaagagcatcctgcaggacctggaaagccaggagtccatggtggcatttttaacatcagctgtagccagtgcagatggggagcaggctcggctccgtgggcagctgaaggagcaaaggctgcgctgccggtgcctggctcacctgctggcctgggcccagaagcagccagaggcagcagccccagccccagggactgggatggattctgtgtgtggggggacccaccgggccctgcagggtgccatggagaaactgcagagctgctttatgcagctgatgcaggaaaaggtggacctgaaagagcgggtggaggagctggaacatcgctgcatccagctctctggagagacagacaccatcggagtctacactgccctctctcagccagggggcagcgctgaaggagcagcaccgagaggaggaggagcacatccacaggctagcccaggacaaggaggagatgaagatctttgccaggtgaccctcaccagcagcgtggagcctgcacaaggagaggccggggagggttctcccctcgacaaccccagtgcacagcagatcatgcagctgtttggtgagatgcagaaccctcaggagcgcccaggcttgggcagcatcccctgcattctgttttcccaccaggctgacaaaaaccaccaggtgaagatcaccctcatctgaaagccagttgccttcagcaaagccaggagaaggggggtgggaggctccgcccccccatgtccctcccacccctttgcagtcacccctttacccttaaagtaaatggattta

SEQ ID NO: 27956 - DNA, 1997 bp, Homo sapiens; identical to SEQ ID NO: 27955

SEQ ID NO: 27957 - DNA, 1277 bp, Homo sapiens; identical to SEQ ID NO: 27940

SEQ ID NO: 27958 - DNA, 1486 bp, Homo sapiens; identical to SEQ ID NO: 27941

SEQ ID NO: 27959 - DNA, 1311 bp, Homo sapiens; identical to SEQ ID NO: 27939

SEQ ID NO: 27960 - DNA, 1784 bp, Homo sapiens
tccctgcttccttttgccagaaaaggtaaagttctggagaaagaggttttttcttggcttttgagttcaggccttacagaggtaaaaccgagtagatgtgggagaacatgtggtaaacagatacaactttcccgggatggggagagaaaaatagtgaaactccatctccactaaaaatacaaaaactagcccggcgtggtggcacgcgcctgtaatcccaactacttgggaggctgcggcaggtgaatcacttgaagccgggaggtgaaggccgcagtaacgctgttccctgcattggatgaagtgctccccaccaaactctctcaccggagagggtgggatctgcgggctccctgggtggcttgatttcgacaccctgtgggctgccttccactctggtactttcctctgcctgctgatgcttgaaattccttgaaccggccacacacacctgctttctggaatcagaacactggaaaggcttcctgggacgggagaagagtgatttacattcctgccgaggtgtaaagctgcggatggcaggttctctcctgagaaccggcttcaactaggaggaggaggttggaagcaggaccccgagctgacctgttgaccaggagaggagtaagcagaagggaggcaggagcgggcggaggagagaaggccggggagccgggatgggggtcaccgcccccggggagccgggatgggggtcaccgcccccggggagcccggatgggggtcaccgcccccgcccccgtgatgccgagctgaaaaagacagtctccaggtaggataatccgtcacactagatgcatatagcttcatgcaagaagagcgactgttgcgctgtcttctaccccctttggccgcgatcccgtgacaatgccggcatccgggcaccaactggcttttgcgaaccgctctccgctccccgcccggattccgaagcccggagccgtttacagtttgaggcgccgtgtgccgccccctggtggccggaggccgttactgtcgcggctgagggggcgtcccggtgtatccgcagcgcgccctggccgccctctggtggccggaggccgttactgtcgcggctgagggggcgtcccggtgtatccgcagcgcgccctggccgccccctggtggccggaggccgttactgtcgcggctgagggggcgtcccggtgtatccgcagcgcgccctggccgacccctggtggccggaggccgttactgtcgcggctgaaggggcgtgtcccggtgtatccgcagcgcgccctggctgccccctggtggccggaggccgttactgtcgcggctgagggggcgtcccggtgtatccgcagcgcgccctgtcccgccatatacattccgtgcttttcaaacacccgccgtgggctaagcatgggacccacgtggggcggggacacacggcgataaagagccaggccctcgctgccaaggagctttcccgtaacaccgatgcatcaaacaaaaggcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcta

SEQ ID NO: 27961 - DNA, 3680 bp, Homo sapiens
gcggttgtggctcaggggtcagctcctgctagtgccaggacactactgggaggctgggacccgaccaaagcccatggtgtctctggcctgagaacaaggtgtcttgggaccataaggccaggccaccaatggccattgggtcataggggctcagccccaatctttgtctttccctggctccttctgattcagtcccatcagggccctggatcccaagactcagcatccaaggtcccctccaggaatcctggcagctcagcatactttatcctgtttcatctgagagcaaaaatgtaaaattggatgcacagaaaagtgactcaaagtgcttaatgactagaagaaatctaggagcagcaagaaggtaatgtggagggagggacctccatgaccggtgtctgcagagccaggggtacaggcacccagtgctgtggcctggcaccacctgcctctcagagggtgggtggcacactccttaaccagaggacagcaggcctggtcaccagcttttctacctgtccctgtaagcatcacattgctggaggaaaatctcatgccagagcttggaccatccctagctcaggggttaggggttgtcccttggtgacctaaatgaaaaaacaggtccagaacagagttcctgatgctggacactcattcagtctttgaatcgtgggaggggaggcctggtactaggtagacctaacctctttgaggaaccacagagcccaaggctggaaatctccagaatcctccaccccctgatcctccctggggacccctgtggcctgtctcactgagaactcttccatctgtagatgtctgggctgctgtacaagggagtcccctttcaggtgtggtgctagacatggtcactcctgctggatgtctaggtggtagaaaccaaggacctagggaaataccaggtacagcctttccccgctcatccagagcaggacaaacaggccaggcggtgtcaggagcccaggtctccagctggagggaacgtcaaccctgcggtgggagcaggggccctttgcacatcctaggcacagatggtaatgtagacaccacaggtaagctgggcttggtacctacccctccccggattcagaaagaaaccaaacaaggagctttgtgcggaatgaaacctcctttcctcccagaagcactgctgactgtttggtggttgccatttgtggcagtgagcctttgtttgttctgaggttgggctggtttctcctcttggtcctgccctacagatcataaaggagaacagcaagaggtccccagcaaacatccacagatggccttggaacctcaccctgcaggaatgccagtgaacatactgctgacatcttggagctcagtaccctcatagtgtaacggcgtcagtagatctgcctgtgcttggacttcctgtactacccattcctgaggggcgatgcttctgcagggcctgtgacttggtgcacaacttcagacaccatcatcttgcagcagcaccgcaccctcactagccagggtgttgatgacttcctcaaggccaaggccacattcaaggcttcggactttattgatgcgcttgtgctgagcaaggtggcttctccaggatcttaattcaggaggtagaatggagcttgagatcaagtgtctgatcaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatgacctgtcattctgctgtttttaccaaaaaggatcatgaggatcagagaggaaaagtcacttgcccaaaatcacacagctgaacagtggtggagttcaactttgaccatgggctgtctggccccaaggtgtatgcttgcttctctcccaagagactcctttcttatcaggctcaaatgaatgaaaggaggatgttaaagttcctagaagctttaattgaatgaaagttcctagtagatctgtacctactaaaaaccacacttctgaagctacgtggccaccagaagacacagctagtctgccatgtaaaaaaggaaaggtggcgtgtgccctgaaggcgcaggggtgagaggcagggaaatggagacccccacagccagcatcagtggccctcatcacagccctccaggagatatcaaaggagacaacgccattattgacgagatcactcccaagcggattggagattgtcccaatacttagacctatagcaaggccttgggagaaatggtggtgcagcaggagagcaggaacctaaccattgccatcctaaggccctccattgtgcggagcaacgtcgcaccagcttttcctgggttgggttgataatctaaatggatgtagccgactcattattgcggctgggaaagggtttcttctgtccataaaagctactccaatggctgtgggagacttaattccaattccaggtgatacagccgtcaatctcccactagctgtaggatggtgtgtgtgctgcagttcacagggcaaaggagatagaagtggatgaaatgagagaattttctttaattgaactctggttaatgccaaaagtgttcaatcactatgtgtggggaagtttcctggtacaaaggaaaaaaaaacaacctaagtcagtgttagtctaccactgtacatctggtaacctcaatccctgcaaccggggcaaaatgggtttccaggtcttggcaacctttgaaattccaattccatttgagagagctttgacgaggccatatgctgatttcaccaccagcaacttcagaacccagtactggaatgccatcagccagcaggcccctgccatcatctatgacttctatctgtggctcactggaaggaaacccagctaccgaaggaagataccctcatcaacccaattttacaaatggagaaatagaagttaagggaagaatctgaagtagtctcaaaggcagtgacaggaaggatgtggagaaagctgagtgtcaaagtcagtattcaggaccggctttactgctactttgagatgaatgaagaaatcagagggaacgcagtgtgctgatgctaaagcagctgtcaccacccagctgtgtgacataggacatattctttctctgtctcacttgactaatatgatatgtcagaggagacatgattgtaattgcctaaagcaattcttgtgatcaagactcagaagcacgaacagtattgccctctgtgttagcccctttataagggaggatatcatcttcagcatgctgaattgtcatctttcttagcagtgcaaatgactaaaacttagccaatgtagagtttgtccaaatttggagctcataactcagttcttgagcaaagtgaaaagaaaacattgtgattatggggaaaatatttgatgggacttatcaaataaagataggaaaagaagaaaacccaaatattataggcagaaatgctaaaggttttaaaatatgtcaggattggaagaaggcatggataaagaacaaagttcagttaggaaagagaaacacagaaggaagagacacaataaaagtcattatgt

SEQ ID NO: 27962 - DNA, 2939 bp, Homo sapiens
ccagtatgcatatattttatacataatatatctttaaacataaacctaatacatacatatatacatgtgtagctgcacttgtgcaactcaacagtttttagtgcaaacagaatcttagtaatggaggtaaataaagaatgaataagaggtaaaaatggatatagaagtaaaacacaagacatgggggtataaataaattaaaactaagttctgaaaagtgacttttagtaatagaaacctaaaaacatttcatagaaggcaagaacaaagtctgacaacagagtttagttttagtggacattgtggtagtaaatatgtaagttacttctctcttcagaatacaacagatctcactgggccttccagggtcattattcctagaaataatcccactaaatgcccatcttagcaacgcacatttccatgtgtgagttatttctctctcagccccatttaaaaatgtgaaatttggatttagaaggggacatgtatttaaggaagagaagtgccacacaaataatggagcaattttaccatgaaattaatgtcatgaaaatagatatttctataaatacctcttgtttttattattaagacaatgcagacataaaacacttcatactgtagtttctacattgcagccaaaccacttatcaatggccaataaattacttcactcctatgatagatacaaatgctcgattcaagttcaattaatagaatagtgtcaggatatcatgcagacagcttgcataaatactcgaggaataatagcataccttcagtagattctgtgatttttaagcatgaaaactttgtcttattccaaatttcaaaagatggaataaagaatgttttcatataaaatacatttggaacagttttccttcttaaaaaaaaaggcatctaacccacttgcaacatatactggcaattcatctttgtagttacaaaatcagatagatatatattctttttcatctcatgtgactgtatgtgaacatttcagtaattccaacaatatcaaacagctaaattcaaaatcatataatactttctaataagtgtatacgatatatatcttttgtagccaaaggcagaaagaccttcagttagttgatttcatgtttgggcactagtttatattttatcagataattaaaagtcattagttatttcacagtataaaatattgaatcaattaccaacaggcttttattttctgctcctaatttcgaaatgtatttggactcgaggtatgggaataatgtcactgcttatcaaacaattttctggaaatcttaatgcacaaaaatttccagatttatatattcaaaaataaattatatgttaaatgaaattaagaaaaaaaggcgaggggaaggagaaaatctagtttatattctgtgtgaatagctttcaatatcttccaggtgggggcaaccgtaagccacttttgagagaagggagaacaggctctttaagctccctgagtctagttacagaagacttcctggcagtaacaccgtgaataaaacaaccacaagcttccaggagatgagacttctaggctctgctccagacaacacccggccatgggcaacagggcccaccgccctgggcgcgccgcagcctcggccactccgagtcggctccgatcgcgcacgcgcgccgtgcacctgccccatcgcgcccagctgctgcctgagctccgggcacgcccgcgctgtgccggcggggagtgtccgtcactctcagcgctcaggatctctccctttccaggaccgctaggaagcaggaaatccttttcctctcacgtttacatcccattcattcttcctccgggcaattcaagtccattcacagccgccacagatgcacgtgtgcacgcgcgcagctgcacctttaaagaaactctcaagtcctggcggccagaaaaccagctttcaggcggggcggtggggctccccctccccttgcttcgtctctgcagatctttgtgctctagggagggatggccgcacattctgacgaggacgagggtggtgcataacgcggaggtcaattttgcacagtccaggcaaaagagaccccccccccccaccaacatcccttcctgttcagtttccctctctggcccagcgcgaagggcgaggggcgacagaagcccgagggacagaaaaccgaggctcctcagtggccgagttgggagagagtgtgagtccaggagagcccgggggcagcagggagagggtgcagaagctcgagcgcaccgagccagaggccccctcttctcccgccacgcggggctggaggtgcaggcgccggttccgcggcgtggcccggctatgtgtcgctcctccgcgcgccgcccgccgcagcccgtgccctcgggccgccgccgccgccgctgccccccgtcgagcccgcggccgcaccctcgggccgatacttgagccagcagatgacccaggtgacaacgaccgagaagagtgccaggatgctggccaccgacaggcagatgggccccacgggcgagggcgagggcgacccggtggccggtgcctcgccagggggcgccccgcctccgggggttcccccgccgccgtagtggttgacgaagatgaggccggtgaagagcagcaccaccatggagaggaaggagaagaccacgcacacgcagccagcgtttctctgcagaagacagcaagatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgctaatagtgaatgtgatgtcttcagtttgaagggctttaagtgaagctcattaaaacccactat

SEQ ID NO: 27963 - DNA, 2939 bp, Homo sapiens; identical to SEQ ID NO: 27962

SEQ ID NO: 27964 - DNA, 497 bp, Homo sapiens
atggacacgcaaaatgtgagtaaggcccttgcagtagggacttacctgacaggtaatgaaccgtgtctaaatttagagaagacagccataaagattcagtcatggtggcgtggaaacatggtgcgccggacgttactgcaggcagcactcagagcctgggtcatccagtgctggtggaggtcaatgcaggccaagatgttggagcaaagacggcgcctggcactaagactctatacctgccaggagtgggcggtggtgaaggtgcaggcacaggttcgaatgtggcaggcccgcaggcggttcctccaggcacgccaagcggcctgcatcatccagtctcactggcgctggcatgccagccaaacccgaggcctgatccggggccactatgaggtcagagccagccggctggagcttgacatcgaaatcctcatgacctagggcgctgacagagccaaggaggctggatctctcttccaataaagacccttactgac

SEQ ID NO: 27965 - DNA, 675 bp, Homo sapiens
atggtcgatgatgctggtgccgctgagtcccagcggggcaaacagactccggcccactccctggagcagctgcgtaggttaccacttccgccgccacagattcgcatccggccctggtggtttccggtgcaggaactgagagaccctttggtgttctacctagaggcatggctggcagacgagctctttggcccagaccgagccataattccagaaatggagtggacgagccaggccctgctgacagtggacatagttgactcagggaacctagtcgaaatcaccgttttcgggcggccccgtgtacagaatcgggtgaagagcatgctcctgtgcctggcatggtttcaccgagaacatcgtgcccgagctgagaagatgaaacaccttgagaagaacttgaaggcccatgcatcagacccccactctccccaggatcctgttgcttaagacaacatagttactgttgggaacatcttaactttctaacttttgctgctaaagttgaagaaaagcaagtatagcattcttaaatccccgtattcctttttcctgtgtcttgatggattgtggtttattttgttgcaagagtgagtttgaactattctaataaagaaatggctattttgccaaaagcattaagatcttcacacacttataataaagcaaatttat

SEQ ID NO: 27966 - DNA, 3210 bp, Homo sapiens
aaaggcggagctcccctggatggcgtcaggtttgcgggcacagagcacagcccaccaggcctgaaggtccgctcaggggccatagtggttgagttctctgtggaactgggatggggtgaacagccagttcccgtcctttggccgcctggccaactgccagacttaaccgctgccgcccaggcatctgtctctagcgttgccactacttgggtagaagtgggggtcggggtggggcgtggagcatcaccggttgccaggccagcactgtctttgcaacacattcagatggcggcgggcagctcgggcgccagcatgggctggcggggctcccctggacggccctcaggtcgctcacagcatcgtcccaggacttcctcggcctgtgccaggtgggcaaggtacgggggtagcttccaaggcttctatcccaactctacctatttctacctattttctcttgagttattttgcctttatctcagttttatttgcaaaaatagtatacgcaaaatacatcgagtgaatgcacatcaggcatatagaagatctggcagaaacatgttttctcctgcccatttccagtcagtatttgaacacagaggcttccacggttttgattctttccacaaaaggttagttttgtctgttttcaccatttatgtaagtgaaactataaattatataatttttatgttcactcactaaacatgcttgtgacacatcattttgctcctattgattattcattattttgtaatattcaattttatgactataccacaggtttgaggcctttgcttgttttgtttttaatccattccactattgatagacacaaaagcagtttctgatttgaggctatcatgaataaacctgctacgaacaaatcagatatacatatttttttctgtaataatattttcacctttcttgagtttaagtacataagagtggattttctgggttataaaataagtatatatttggcattgtatgaaatggggagacattttcctaagtggttatgccatcttaaactacaatgaaaatgagagaatcagttccactttctaaccaatacttgacgctgtcagttgttttagtattatccattcttatgggatataactgctgagtagctgtctgccttctcccataacacagaaaattgagggcccagaggacagttttattttcatatttgacatcttctattattttttatagaaggatgatttcagtagtaaaattttctttcaattttctaggttgtctctgaatcttactggggttccttgtcctaaaccacattcaggaatgctgtccctcattgggaccacaacacccagataatttttttttttttgtagaaagaggagccttgctatgttgcccaagctggcctcaaactcccaccctcaagagatctgcccatctcgacaaccagagtaactggttctacaggaaaataccactatcccatgataattatattttattaatttttatttgcatagacaggaggtcttgctatgttgcccagggtggtctcagactcctggacttgaacaattctcccatctgtgccatctgtgcctcccaaagtgctcccaaggtgctgacgccacaggcataagccactgcacctggcccgacttaagatgtctttaatctagcatcccatacttcatataatcaggaaaagcagtagtgttttttttttttaattacttagtatctcaacaagaatcaaccatctctcaccattgtcaggaccctggtcagaaccactatcatctcctacctggatgttgccacagcttggcctccgtgcttctacccaaatcttcccacaatctttctcaactcagccaccatgggatgcttttaaatcaatagacagttcgtgtcacctctctgctcagaacccttccgcatctcccatctcagacacagcataaaagccaaagccccagcaatagcctcccagggcttgcacaatctgtactgatctgagtcccacaactccctggcctcctcccctaccttctctccccctctctgctcgacaatcctctttcctgagcttcagacacaccacggagttccctcttagcatctttattctgttgtttctgcctataatgctcttccctcagtaccttggccagctccttcccctccttcaagtctttgctcaattttcacttaggaggccaaccctgaccactctatttaatattgctatgtgtccccattcctgccatgctcactcatttctttttactttttttttaagatataatctcgctgtgtcactcaggctggggcaccatggcacgatcacaacacactgagacctggaactcctaggtcaagaaatcgtcctgcctcagcgcctctagtggctgggactacaggtgcatgccactacacccgctattttttttttcccatgtagacagggtatcactttgttgcccaggcttatcttgaactcctgggccagagcaaccatcctgcctcggcctcctggatagctggaattatgggtgtgggccactacccctggcttcatgttcatttcttcttgctgctgttacaaactaccctacgttgagtggcttaatacaccacaaatctactacctaacaggtctgggggccagaagtccaaaataggtctattaaggctaaagtcaaggtgtcagcaggactgcatcccttctggaggttccagagagaaggtgttcccttgcctttcccagttccaaaagccacccctattctttgcctcatggcccctaaatgcatcttcaaagccagaagcaaagcatattcaaatctccctctgtgacctgtgcttccatcatcaaatctccttcaattctgactctcttacctccctctttcacttataaagacctcttgtgattgctggacacagaggccggtgctcacaaccatggtcccagcagtttaggaggtcgaggcaggagaaatgcttgaggccagaagttcgggaccagcctgggaaacacagtgagacccacccccctcaattaaacaacaaaaagaaataagagaaaattagctgggcgtggtggtatgcatctgtagtttcggctacttgagaggctgtggtgaaaggattgctttagcaccagagttcaagaccagcctcggcaatataacaagatcccatctctac

SEQ ID NO: 27967 - DNA, 408 bp, Homo sapiens
atgcacccagctttggtacctccccttgggatctgcccccctgggcttttcccaccagctcccttgctgaaccctgagattttaagtgccccacccggcttgattcagcgatccaaggtagataatacaagtgcagccaccgttgagaagaaagccacagcaaccgtcactgccaaaccacagatcactaatcccaaggcagagattactcgatttgtgcccagtgcattgagagtacgtcgggagaataaaagggctactgctgcttcccaaagaaagtcagaggataattctgctgtgcctcttgccaaagcagcacccaaatctggtccttctgttcctgtctcagtacaaactaaggatgatgtctatgaggatttcatgaaagagatggaagggctactgtga

SEQ ID NO: 27968 - DNA, 408 bp, Homo sapiens; identical to SEQ ID NO: 27967

SEQ ID NO: 27969 - DNA, 1595 bp, Homo sapiens
aatcagttctgagcctcctcgcctcccggctctcccgcctgttgcgggtgtttatccggctgctgggcgacctttcccgggaaggaggctgtgccttcattcggtcacgccccggtctggggaggctcctccctggtgcgcagaaaccgcaggggcggggaggagccgggctctgcctgcgcccggggcagagcggggctggcaccgcgcaaggggccctgtttccggggagactgatttcggcctcctgacctcgggaccccttgactgtggagtgtcagacggaggaggacttagtgatcttgtccaaccccctccccgcttttcacaggttggggagatgggcgcctggagaatggaaatccagttatcaaaattgactccagaagagagaaactaacagaacaataacaatggaggaaattgagaacattatcaaaaagctatcatcctgccaaactccaggctcagattgtcttacaggttaaaaaaagttagtccttcatgaaaatgaaagaccttaagcaacacgatggattcagaagctcatgaaaagaggccaccaacactaacatcttcagaacaagatatatcacctcgtattacaaatgttggtgaaatgaagcattacttgtgtggctgctgcgcagccttcaacaacatcgcaatcacatatcccattcagacggtcctctttcgacaacagctgtatggcatcaaaacccgggatgcaatattttagttgagaagggatggatttcgaaacttgtatcctggaatccttcccccattgatgcagaagacagctacacttgcacttacgttcggtctctatgaggatttatcctgccttctccacaagcatgtcagtgctccagagtttgcaacctgttgcatggcggcagtgctcgcagggacaacagaagcaattttcactccaccggaaatagttcagacgttgattcaagaccacaagcatcatgacagatttaccaacacttatcaggccttcaaggcactgaaatgtcatggaattggagagtattatcgaggcttggtgcccattcttttccagaatggactcagtaatgtcttgttttgcgggctttgaggtcccattaaggagcatctgcctacagaaacgactcacagtgctcatttggtcaataattttatctgtggaggtccactgggtgccatgttgggattcttgtttttttccaattaatgtaaaaactcgcatacagtctcagattggtggggaatttcagtctttccccaaggttttccaaaaaatctggctggaacgggacagaaaactgataaatcttttcagaggtgcccatttgaattaccatcagtcccttatctcttagagcataatcaatgcaacttatgagtaaaggttatatgaaaaaaaccaacagtttagtgccatttatcaactgaatagaccttctaagaagaatgcagtttggcctctttcttagttggccaaatacaagttggtgtcataactccaggccacagtgagttatgggcaaagctgttttgcttaagcctcaataaaacagaataaaagattccaataggaa

SEQ ID NO: 27970 - DNA, 1016 bp, Homo sapiens
gggtctgcgcccctctccgtgtggagcccacctgcatgtactggctccccaacatgcacggcaggagcggcggcccagcacttggcactggccacttgcagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcatggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaa

SEQ ID NO: 27971 - DNA, 1356 bp, Homo sapiens
gtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggcgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtggctaatctttgattctatgtttttgatcctcctggcactccagacctgggtgatatgcaggagagcacactgatagaaatccttgtgtccagtgcccagcaactcctgcctcagcctcccgagcagctgggactacaggtgcccgccaccacgcccgtctctactaaaaatacaaaaaattagcggggcgccgtggcgggcgcctatatagtcccagctactcgggaggctgaggcaggagaatggcgtgagcccgggaggcggagcttgcagtgagccgagatagcgccactgcactccagcctgggcgacagagcgagactccgtctcaaaaaaaaaaaaaaaaaa

SEQ ID NO: 27972 - DNA, 845 bp, Homo sapiens
atgcacacatcttcttctccaagcagctcccagcggccctgcacccaccaccagcatccgtttcacctgcagttgaagatccgtgaggtgcccagaagatcatgcagtcatcagtcccacggagcagcccgcgaggctgaggctcctcccactggaccgccccccaactggcaccactgctgcccctgcccctactctcagcctcacgtgactctcgggcagaggcagtggtggggcagccagggcagcgtcaagagtctgagccagctgcaggacaaattcgagcatcttaaaatgattcaacaggaggagataaggaagcttgaggaagagaaaaaacaactggaaggagaaatcatagatttttataaaatgaaagctgcctctgaagcactgcagactcagctgagcactgatacaaagaaagacaaacatcctgatccatatgaattcctcttattaagaaaaataaagcatccaggattcaatgaagaactgactatcaccttgttaatcattcagaaacatgttgcacgcttaagccatttttgatatagatactgaaacaattacttgctaagagcaatcttgaaggtatggataaggccctgagtcatcttcctgagctgaatgatagttaagctgaatgtacgtataaaatatgattttctaaccacttgctcgccaacaaggaaaacttttaagtagagcagaacctgaatagacaagacatttctttcttttggtagaaaatgatttaccatcactgtgtagttaattgtagactaggtaattttaactttgtgatttattgccggagacattttcttctgtactgtaaagtg

SEQ ID NO: 27973 - DNA, 4927 bp, Homo sapiens
atgtcagaaaaaacacaacaggggaaattggccgcagccaagaaaaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccagcctttgatcttacaacccagtcccctaagttttctcaccccatttctggttcctctggttgcagcacaaatttccagctggaaggggagtggagactatgggacctaggagcaagaggtttcaggctgccttactcccttaacatagacattgacagtgggaaaagcctacacttcccctgtgagctcaaaatgttcacattaaaagcatattggcagaggaagagccctggcattccagcaggagctaacaggaaaaagaaagtcaatggcagtagccctgacacagccacttctggtggttaccactcacctggggattcagcaacaggtgtctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctatgtgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtcaagaaattgaaaaaaaaaaaaaacaaaacatttaaggggttaatatcctacacaattcatttacttcatttgaatgttagagccacttatgtttatttgtgtttctaatttatagtttaaatttatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttctggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagctttcaatttgcttagaaggcaatattagaaggttagagttcagcagaaagagagaattttaaaatgtgagttcgactgaataaatttgaatttctgtaggaagtaaagaatcaaaatacctatttaaagactgcaatatatgataattatttttaaagtaatagattaaacctgataggttttcctgaaatgaaaaacaatcagttctaaaaccaaagctgatttttagaaaatgtgaaaatgtaaatcaaccctatccaaaatagattctctaaaactttatcttacagtcactttcaaataactattcaaaaatgtaactgttaaattaatgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaataaattattagattgtttcaaggtgctgttttgcctaaaaattttgtgtgtcttgaaaactatagtattaaaggtattgagactgtgcaaatgctgggcatgcttggcatgagataatcggtttttattcttacaaaattgtaaccatgtaagtgtgtttattaaaagaacacaaactaaaaa

SEQ ID NO: 27974 - DNA, 4557 bp, Homo sapiens
atgtcagaaaaaacacaacaggggaaattggccgcagccaagaaaaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagcgcccctaggaactgtcattactgctgcaagaccagcctttgatcttacaacccagtcccctaagttttctcaccccatttctggttcctctggttgcagcacaaatttccagctggaaggggagtggagactatgggacctaggagcaacaggtttcaggctgccttactcccttaacatagacattgacagtgggaaaagcctacacttcccctgtgagctcaaaatgttcacattaaaagcatattggcagaggaagagccctggcattccagcaggagctaacaggaaaaagaaagtcaatggcagtagccctgacacagccacttctggtggttaccactcacctggggatagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgctgttttgcctaaaaattttgtgtgtcttgaaaactatagtactgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaa

SEQ ID NO: 27975 - DNA, 6520 bp, Homo sapiens
attgagcagtgctcactggtatttcgctgatgtggccccaaccccgcctccctccccaccccgcgatgtcagaaaaaacacaacaggggaaattggccgcagccaagaaaaaggtaaaacacaccaggtcacggcccccaacccagccacagatcccctccgatgacaagaccggtgccagagtccataccactcctgaggcataccagatggggccccccaaccccagccctctgggctcccccaaccaaagcctagtcagtcagccccaccccttcagcaagcagcccagtccctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccagcctttgatcttacaacccagtcccctaagttttctcaccccatttctggttcctctggttgcagcacaaatttccagctggaaggggagtggagactatgggacctaggagcaagaggtttcaggctgccttactccctcaacatagacattgacagtgggaaaaagcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgtgggacatctttctgaagcatcattttcccttgattctcttgagaaaatgcattaatgtacttagggatgacagacacataggtttccaagcgtataccagacttcgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtgtgcttttctacctctgcccctggttttggtccctggaagctgctgattcatggcaaaaccccagagcttggagtcagaggactgagtttaagttccagtattgccttttttgatctttctttttttttttctatccatgatatcaatccctctcagtcactaagtgattgtgacaacaccttgtacagttgttggtggcattacatcagatggtatataagggtattttgtcaaaactgtaaaggaggatgtggctgtaggggctgatcattctcatgagtgttaccgctcttctttcccacagttaaaagcatattggcagaggaagagccctggcattccagcaggagctaacaggaaaaagaaaatcaatggcagtagccctgacacagccacttctggtggttaccactcacctggggatgtgagtctcggcgggccagggtcctggcgacagggggcccaaggggcagtagagggtaattgttaagattgtagatggactgttgggtactggttaagaattctggatttgaatcctgcctctccatctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacaccgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatgggaaaaagggtccaagataggcagaaaagaagcttttgccagttgatgggggaagaaaggaagtcagagggcttagacagtgaggggggacagaacatctccatgtgcactctcatctcttgcagtcagcaacaggtatctacggggagggccgtgcatcctctactaccctggaggatctggaggtaagaggccctgggctgaggtgcagtgaccctgcaggccagccctccaacctcctcccacagcaggggcttgttgcccctctgccagctgaggcagcccacacacccccaccagccctaatgattattctctctacccctccccacaatcttcctccaactccttctctctgcatgcacctcagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggaggagctcctggagcaggagaggcttcggcaacaggatgagaggctgtggcagcaggagactctgcaggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgggtggagaagctgttggtacaggagaggcggcaggaggagcaggagaggctgcatgccattcttttcgggctgccgagaacagggagctaaacatcaccatcatctaagagcgggtcaaggaattaaaaaaaaacaacaaaacgtttaaggggttaatatcctacacaattcatttacttcatttgaatgttagagccacttatgtttatttgtgtttctaatttatagtttaaatttatttgtgtttctaatttatagtttaaatttatttgtttctaatttatagtttaaatttatttgtgtttctaatttatagtttaaatttatttgtgtttctaatttatagtttaaatttatttgtaaaaagtcaaatgacagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcatgtatattcattacggaattcagataaaatttccttatgttctgctattatgtttgatcgaatcctaatcacagtgagctcttcattagctcaatatgcggtttgccctctggaaacagcctttccccctttttctgtgtattggggatgggagtaataacattttggggaggtttttaaatctcccagaagaggaaagtggcctgctctggcaggtgtgtgcaggatagaatatgtttcatttgttccggtgccaagaatgagcgctgtactatggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcattctccttaatgtgtttagtaaagatcagaagaaatcctttaagagtttaaatgcccctggaacaggcatatacaggctctagtcaagaatgaattcgagtgaaggaaagctgtgggacacctggcattcctctatgttcatggagcttatttgaggctagaagatggattttaccatctagacctctctggctaatagctagtcttcaaccatctgacataggaatttacttcttttccttgaatggagaacactttaaaaataataacaattattataaactaatatatgtgagagtacttagttgaaacaaaaaggaattttagtagacagtattatactacatttgaaaatcaaggagcagtttatgcaacttaaaatgtttacaaacggcagcgcaatctactgtttgtgactgtcaaagtgtcatgaggaaagtgtctatacaatcacagacttatatttcctcacaaaattctttacgtagagtgaaatatgtttttatacctctcagtttcagttagaggcatattttgtgtaatatttatggcttaaaatggactaaaggtcctgttcttgccttttctgaacttgccgcttttgcattctttgagttcagtttaaagacacttactttaactccattttaaaccctcgggctagaaatcgtaccactgttaattagccacattatttggtctaacagtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagcctttaatttgcttagaaggcaatattagaaggttagagttcagcagaaagatagaattttaaaatgtgagttcgactgaataaatttgaatttctgtaggaagtaaagaatgaaaatacctatttaaagactgcaatatatgataattatttttaaagtaatagattaaacctgatagtttttcctgaaatgaaaaacaatcagttctaaaaccaaagctgatttttagaaaatgtgaaaatgtaaatcaaccctatccaaaatagattccctaaaactttatcttacagtcactttcaaataactattcaaaaatgtaactgttatattaacgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaatagattattagattatttcaaggtgctgttttgcc

SEQ ID NO: 27976 - DNA, 4306 bp, Homo sapiens
atgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaaatcaatggcagtagccctgacacagccacttctggtggttaccactcacctggggatagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggagaggctgtgtgaacaggaggagaggctacgtgaacaggaggagaggctacgtgaacaggaggagaggctgtgtgaacaggaggagaggctacgtgaacatgaggagaggctgtgtgaacaggaggagaggctgtgtgaacaggaggagaggctacgtgaacaggaggagaggctacatgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggaggagctcctggagcaggagaggcttcggcaacaggatgagaggctgtggcagcaggagactctgcaggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgggtggagaagctgttggtacaggagaggcggcaggaggagcaggagaggctgcatgccattcttttcgggctgccgagaacagggagctaaacatcaccatcatctaagagcgggtcaaggaattaaaaaaaaacaacaaaacgtttaaggggttaatatcctacacaattcatttacttcatttgaatgttagagccacttatgtttatttgtgtttctaatttatagtttaaatttatttgtgtttctaatttatagtttaaatttatttgtttctaatttatagtttaaatttatttgtgtttctaatttatagtttaaatttatttgtgtttctaatttatagtttaaatttatttgtaaaaagtcaaatgacagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcatgtatattcattacggaattcagataaaatttccttatgttctgctattatgtttgatcgaatcctaatcacagtgagctcttcattagctcaatatgcggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctctggcaggtgtgtgcaggatagaatatgtttcatttgttccggtgccaagaatgagcgctgtactatggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcattctccttaatgtgtttagtaaagatcagaagaaatcctttaagagtttaaatgcccctggaacaggcatatacaggctctagtcaagaatgaattcgagtgaaggaaagctgtgggacacctggcattcctctatgttcatggagcttatttgaggctagaagatggattttaccatctagacctctctggctaatagctagtcttcaaccatctgacataggaatttacttcttttccttgaatggagaacactttaaaaataataacaattattataaactaatatatgtgagagtacttagttgaaacaaaaaggaattttagtagacagtattatactacatttgaaaatcaaggagcagtttatgcaacttaaaatgtttacaaacggcagcgcaatctactgtttgtgactgtcaaagtgtcatgaggaaagtgtctatacaatcacagacttatatttcctcacaaaattctttacgtagagtgaaatatgtttttatacctctcagtttcagttagaggcatattttgtgtaatatttatggcttaaaatggactaaaggtcctgttcttgccttttctgaacttgccgcttttgcattctttgagttcagtttaaagacacttactttaactccattttaaaccctcgggctagaaatcgtaccactgttaattagccacattatttggtctaacagtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagcctttaatttgcttagaaggcaatattagaaggttagagttcagcagaaagatagaattttaaaatgtgagttcgactgaataaatttgaatttctgtaggaagtaaagaatgaaaatacctatttaaagactgcaatatatgataattatttttaaagtaatagattaaacctgatagtttttcctgaaatgaaaaacaatcagttctaaaaccaaagctgatttttagaaaatgtgaaaatgtaaatcaaccctatccaaaatagattccctaaaactttatcttacagtcactttcaaataactattcaaaaatgtaactgttatattaacgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaatagattattagattatttcaaggtgctgttttgcc

SEQ ID NO: 27977 - DNA, 3982 bp, Homo sapiens
acaacccagtcccctaagttttctcaccccatttctggttcctctggttgcagcacaaatttccagctggaaggggagtggagactatgggacctaggagcaagagttaaaagcatattggcagaggaagagccctggcattccagcaggagctaacaggaaaaagaaaatcaatggcagtagccctgacacagccacttctggtggttaccactcacctggggatagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggaggagctcctggagcaggagaggcttcggcaacaggatgagaggctgtggcagcaggagactctgcaggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgggtggagaagctgttggtacaggagaggcggcaggaggagcaggagaggctgcatgccattcttttcgggctgccgagaacagggagctaaacatcaccatcatctaagagcgggtcaaggaattaaaaaaaaacaacaaaacgtttaaggggttaatatcctacacaattcatttacttcatttgaatgttagagccacttatgtttatttgtgtttctaatttatagtttaaatttatttgtgtttctaatttatagtttaaatttatttgtttctaatttatagtttaaatttatttgtgtttctaatttatagtttaaatttatttgtgtttctaatttatagtttaaatttatttgtaaaaagtcaaatgacagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcatgtatattcattacggaattcagataaaatttccttatgttctgctattatgtttgatcgaatcctaatcacagtgagctcttcattagctcaatatgcggtttgccctctggaaacagcctttccccctttttctgtgtattggggatgggagtaataacattttggggaggtttttaaatctcccagaagaggaaagtggcctgctctggcaggtgtgtgcaggatagaatatgtttcatttgttccggtgccaagaatgagcgctgtactatggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcattctccttaatgtgtttagtaaagatcagaagaaatcctttaagagtttaaatgcccctggaacaggcatatacaggctctagtcaagaatgaattcgagtgaaggaaagctgtgggacacctggcattcctctatgttcatggagcttatttgaggctagaagatggattttaccatctagacctctctggctaatagctagtcttcaaccatctgacataggaatttacttcttttccttgaatggagaacactttaaaaataataacaattattataaactaatatatgtgagagtacttagttgaaacaaaaaggaattttagtagacagtattatactacatttgaaaatcaaggagcagtttatgcaacttaaaatgtttacaaacggcagcgcaatctactgtttgtgactgtcaaagtgtcatgaggaaagtgtctatacaatcacagacttatatttcctcacaaaattctttacgtagagtgaaatatgtttttatacctctcagtttcagttagaggcatattttgtgtaatatttatggcttaaaatggactaaaggtcctgttcttgccttttctgaacttgccgcttttgcattctttgagttcagtttaaagacacttactttaactccattttaaaccctcgggctagaaatcgtaccactgttaattagccacattatttggtctaacagtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagcctttaatttgcttagaaggcaatattagaaggttagagttcagcagaaagatagaattttaaaatgtgagttcgactgaataaatttgaatttctgtaggaagtaaagaatgaaaatacctatttaaagactgcaatatatgataattatttttaaagtaatagattaaacctgatagtttttcctgaaatgaaaaacaatcagttctaaaaccaaagctgatttttagaaaatgtgaaaatgtaaatcaaccctatccaaaatagattccctaaaactttatcttacagtcactttcaaataactattcaaaaatgtaactgttatattaacgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaatagattattagattatttcaaggtgctgttttgcc

SEQ ID NO: 27978 - DNA, 5055 bp, Homo sapiens
acagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggtaagagtccagtggggtcccctgattacagctggtcaatcctggactccagtttcctcttggggccctgaagaaaggggctaggggcccctgatgccaagggcaaatggggagctgggcacccaggtctcacctggagggaccccagagcacagaacatgcagcatggctcttctgcactgccctctttgctgactctctcttctccagacacccctgctctagtccttgccacacatgccctggggttgtcacctctctgggaagcactagcctgactggttgtcaggggtccatatttctgccctgcctcagtccctaatttgctttttgagtctggagaagccatctctcctctttatgctcgtgtttctggaggaggtagagagtatcaaaggtctcggttagctctgaaagtcagagatttaaaggcccctagaatggaaacctcagggccaagggctcctgtctgtcctttgctgttttatatctctgctatgaagaactgtacctggcctgtacatgctcagtaaatgtttgttgaatgaatgcacgtttctaaatcacaaactggcagaaggggggtgggcccttctcaaactctgtctctagaggttcaccagcccctccctccagggcccttttccccctttgctttgggcaggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggagaggctgtgtgaacaggaggagaggctacgtgaacaggaggagaggctacgtgaacaggaggagaggctgtgtgaacaggaggagaggctacgtgaacatgaggagaggctgtgtgaacaggaggagaggctgtgtgaacaggaggagaggctacgtgaacaggaggagaggctacatgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggaggagctcctggagcaggagaggcttcggcaacaggatgagaggctgtggcagcaggagactctgcaggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgggtggagaagctgttggtacaggagaggcggcaggaggagcaggagaggctgcatgccattcttttcgggctgccgagaacagggagctaaacatcaccatcatctaagagcgggtcaaggaattaaaaaaaaacaacaaaacgtttaaggggttaatatcctacacaattcatttacttcatttgaatgttagagccacttatgtttatttgtgtttctaatttatagtttaaatttatttgtgtttctaatttatagtttaaatttatttgtttctaatttatagtttaaatttatttgtgtttctaatttatatttaaatttatttgtaaaaagtcaaatgacagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcatgtatattcattacggaattcagataaaatttccttatgttctgctattatgtttgatcgaatcctaatcacagtgagctcttcattagctcaatatgcggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctctggcaggtgtgtgcaggatagaatatgtttcatttgttccggtgccaagaatgagcgctgtactatggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcattctccttaatgtgtttagtaaagatcagaagaaatcctttaagagtttaaatgcccctggaacaggcatatacaggctctagtcaagaatgaattcgagtgaaggaaagctgtgggacacctggcattcctctatgttcatggagcttatttgaggctagaagatggattttaccatctagacctctctggctaatagctagtcttcaaccatctgacataggaatttacttcttttccttgaatggagaacactttaaaaataataacaattattataaactaatatatgtgagagtacttagttgaaacaaaaaggaattttagtagacagtattatactacatttgaaaatcaaggagcagtttatgcaacttaaaatgtttacaaacggcagcgcaatctactgtttgtgactgtcaaagtgtcatgaggaaagtgtctatacaatcacagacttatatttcctcacaaaattctttacgtagagtgaaatatgtttttatacctctcagtttcagttagaggcatattttgtgtaatatttatggcttaaaatggactaaaggtcctgttcttgccttttctgaacttgccgcttttgcattctttgagttcagtttaaagacacttactttaactccattttaaaccctcgggctagaaatcgtaccactgttaattagccacattatttggtctaacagtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagcctttaatttgcttagaaggcaatattagaaggttagagttcagcagaaagatagaattttaaaatgtgagttcgactgaataaatttgaatttctgtaggaagtaaagaatgaaaatacctatttaaagactgcaatatatgataattatttttaaagtaatagattaaacctgatagtttttcctgaaatgaaaaacaatcagttctaaaaccaaagctgatttttagaaaatgtgaaaatgtaaatcaaccctatccaaaatagattccctaaaactttatcttacagtcactttcaaataactattcaaaaatgtaactgttatattaacgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaatagattattagattatttcaaggtgctgttttgcc

SEQ ID NO: 27979 - DNA, 4819 bp, Homo sapiens
gacatctttctgaagcatcattttcccttgattctcttgagaaaatgcattaatgtacttagggatgacagacacataggtttccaagcgtataccagacttcgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtgtgcttttctacctctgcccctggttttggtccctggaagctgctgattcatggcaaaaccccagagcttggagtcagaggactgagtttaagttccagtattgccttttttgatctttctttttttttttctatccatgatatcaatccctctcagtcactaagtgattgtgacaacaccttgtacagttgttggtggcattacatcagatggtatataagggtattttgtcaaaactgtaaaggaggatgtggctgtaggggctgatcattctcatgagtgttaccgctcttctttcccacagttaaaagcatattggcagaggaagagccctggcattccagcaggagctaacaggaaaaagaaaatcaatggcagtagccctgacacagccacttctggtggttaccactcacctggggatagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggagaggctgtgtgaacaggaggagaggctacgtgaacaggaggagaggctacgtgaacaggaggagaggctgtgtgaacaggaggagaggctacgtgaacatgaggagaggctgtgtgaacaggaggagaggctgtgtgaacaggaggagaggctacgtgaacaggaggagaggctacatgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggaggagctcctggagcaggagaggcttcggcaacaggatgagaggctgtggcagcaggagactctgcaggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgggtggagaagctgttggtacaggagaggcggcaggaggagcaggagaggctgcatgccattcttttcgggctgccgagaacagggagctaaacatcaccatcatctaagagcgggtcaaggaattaaaaaaaaacaacaaaacgtttaaggggttaatatcctacacaattcatttacttcatttgaatgttagagccacttatgtttatttgtgtttctaatttatagtttaaatttatttgtgtttctaatttatagtttaaatttatttgtttctaatttatagtttaaatttatttgtgtttctaatttatagtttaaatttatttgtgtttctaatttatagtttaaatttatttgtaaaaagtcaaatgacagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcatgtatattcattacggaattcagataaaatttccttatgttctgctattatgtttgatcgaatcctaatcacagtgagctcttcattagctcaatatgcggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctctggcaggtgtgtgcaggatagaatatgtttcatttgttccggtgccaagaatgagcgctgtactatggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcattctccttaatgtgtttagtaaagatcagaagaaatcctttaagagtttaaatgcccctggaacaggcatatacaggctctagtcaagaatgaattcgagtgaaggaaagctgtgggacacctggcattcctctatgttcatggagcttatttgaggctagaagatggattttaccatctagacctctctggctaatagctagtcttcaaccatctgacataggaatttacttcttttccttgaatggagaacactttaaaaataataacaattattataaactaatatatgtgagagtacttagttgaaacaaaaaggaattttagtagacagtattatactacatttgaaaatcaaggagcagtttatgcaacttaaaatgtttacaaacggcagcgcaatctactgtttgtgactgtcaaagtgtcatgaggaaagtgtctatacaatcacagacttatatttcctcacaaaattctttacgtagagtgaaatatgtttttatacctctcagtttcagttagaggcatattttgtgtaatatttatggcttaaaatggactaaaggtcctgttcttgccttttctgaacttgccgcttttgcattctttgagttcagtttaaagacacttactttaactccattttaaaccctcgggctagaaatcgtaccactgttaattagccacattatttggtctaacagtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagcctttaatttgcttagaaggcaatattagaaggttagagttcagcagaaagatagaattttaaaatgtgagttcgactgaataaatttgaatttctgtaggaagtaaagaatgaaaatacctatttaaagactgcaatatatgataattatttttaaagtaatagattaaacctgatagtttttcctgaaatgaaaaacaatcagttctaaaaccaaagctgatttttagaaaatgtgaaaatgtaaatcaaccctatccaaaatagattccctaaaactttatcttacagtcactttcaaataactattcaaaaatgtaactgttatattaacgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaatagattattagattatttcaaggtgctgttttgcc

SEQ ID NO: 27980 - DNA, 1513 bp, Homo sapiens
aaacttcctccgtcctcctcctcccccccccccatgcaggcgacgccgagtgaggctgaggctgggggcgaatcgccgcagagctgcgtgtcggcggcgcattctgattggacagcggggaagcccgtcagcctgttggccccgctgatcccgccccgtagcgcagggcagcctttaacctttagccccagtgggcgccagccactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgagtaagtttagtaacttgtcttctgaaaatcagtaccagattgcattaaataaaagtaattgccagtttagttagtggccattaatagtttaaataaatttttttgagaatcgtaatatcaccgttaagacagttgatcagttttcaggccgaattttggagggttatgccagcaaacttgaaaaatagttcagtgaaattttaacaagtagagccaaggctagggagttggggcacaaatctaaaagattgccaaaa

SEQ ID NO: 27981 - DNA, 970 bp, Homo sapiens
aaacttcctccgtcctcctcctcccccccccccatgcaggcgacgccgagtgaggctgaggctgggggcgaatcgccgcagagctgcgtgtcggcggcgcattctgattggacagcggggaagcccgtcagcctgttggccccgctgatcccgccccgtagcgcagggcagcctttaacctttagccccagtgggcgccagccactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgatgactttttttctctctttaatagcaatgatcaaagctgaagaaagcagtaagcaagaagagtgcaccacaacatcaacagccccagtccctacaacagaaattccgaccaca

SEQ ID NO: 27982 - DNA, 417 bp, Homo sapiens
aaaaagtcacagaagaatgtggagacacttagcaaaacggactctcataagagtgttcgatggtgctgctactaatgaaagatttgaggaaactcctaaggtccctccagtgtacaacaatttggaacttccattttctcaacaactgctcttccaagatgctgcctcatttcagagccatgttttactcatgagctggtcctgtccagaaaacagccaatgctcattcccgacactttcttgtcactgctcttttctgttccctattttgtcagtaaggaagtaaacaaccgctaaaacaaccctctaacaacagaagaccctcatgagaacaccaggcagcagaagcttctttagcagtaaaagatatctggatattcatattttgttccatgatcttcaacattaaataaataa

SEQ ID NO: 27983 - DNA, 1854 bp, Homo sapiens
ggatctcctgcccttggtcctacgtgccactatctgtgctgagtttttcaaaggtcagagcagattgaaccattgtggtttcattttccctgattttgatttttcttatggggaacctgtgtggctgcattcaaggtgactcgaagaagccttccaaaaagcgtgtgaaaaggaagccctactctactaccaaggtgacttcagggagcacattcaatgagaatataagaagatatgctgtgcacaccaaccagtgtaggagacctcatggctcccgggtaaagaagaagaggtacccacaagaagatgacttccatcatacagtcttcagcaatcttgaaagattggacaagcttcagcccactcttgaagcctctgaggagtctctagttcacaaggacagaggagatggagagaggccagtcaacgcgagggtggtgcaggtggcccctctgaggcttgaatctagagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatga

SEQ ID NO: 27984 - DNA, 530 bp, Homo sapiens
gctgagtttttcaaaggtcagagcagattgaacctttgtggtttcattttccctgattttgatttttcttatggggaacctgtgtggctgcattcaaggtgactcgaagaagccttccaaaaagcgtgtgaaaaggaagccctactctactaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcag

SEQ ID NO: 27985 - DNA, 1854 bp, Homo sapiens
ggatctcctgcccttggtcctaagtgccactatctgtgctgagtttttcaaaggtcagagcagattgaaccattgtggtttcattttccctgattttgatttttcttatggggaacctgtgtggctgcattcaaggtgactcgaagaagccttccaaaaagcgtgtgaaaaggaagccctactctactaccaaggtgacttcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgtgagggtggtgcaggtggcccctctgaggcgtgaatctagagccattgacactggagaatgatacctaccctgaaataactcacttcctgagaaaaaagcgccatctctagggtacagaaacctgattctgggctccttttgggaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaacaaaacaggaaatatgtgtcatattggacttggtcttttccgggtttattggcataatagttagaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttcctccaacctggagacagaattctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctagcagtctgacggcagcacctgtgttcctctgcactgggccgtggatgacattacacaccttgccactcccacggtcctgtgtgttccggatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctttacatatctacattgtttgcagattttacaataatcatttattcttgcatggctgatcattgttaaccaatacaaataaaataataaagaaatga

SEQ ID NO: 27986 - DNA, 543 bp, Homo sapiens
tgccactatctgtgctgagtttttcaaaggtcagagcagattgaaccattgtggtttcattttccctgattttgatttttcttatggggaacctgtgtggctgcattcaaggtgactcgaagaagccttccaaaaagcgtgtgaaaaggaagccctactctactaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcag

SEQ ID NO: 27987 - DNA, 361 bp, Homo sapiens
acggattaattcaatggcagctcactttctccttttatgatcggatgggtccgaaagtgaggaaaaagacaattgtctacaaagaaagaggctgccaagtggagacagaaaagcagttatgagactgatgatagattccaatttgttatcgtacacgggtgctctagattttcctatcaatagagggcgtcctcgagtcattgcaaatcctggtgtcgttaaacggaactgttcttcagaggaaaaacttcatctctataagaaaggaaggaggagacctgaacagtacatccggagaatccagcaaagcatactacggcatgaacgtgcaagtggacagaattaaaacacatgccagaaa

SEQ ID NO: 27988 - DNA, 3437 bp, Homo sapiens
tacaactcttgttttctcttttttaaaaataataaaacagtaaatgaagaaaagacacagagaaggatgtgacatgcctgggccatggagcactctgagatctcatcggggacaccactgcccacacctccatcccgtcctgcgcaggccgacactcactgacgttgaagcctgccttcagtgcctggatgtctgcggccaccccagacatgcggtagatgcccacctcctccatgcctcggcgctcgatctcctccatgcactggcgcacgatgtagggcaccttggacctctctctcctgcgggaggagggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcctcattgcatgtactttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaaaccctgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtgtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaataggcttctcttggcaactgactcgtgacaaagggttcaagattgtttgaaaaaaaaaaaaggggggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaagaagaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatggcacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcacgtggacagaaagagaaggaaagagggccctatatctggataacttggaaatgtgctccccctagcaagatatctaccaaaattaaaaccatatttgaggatgctggcactgcgagcaatatataaatgatgcatgtaacatcatttaatatgatcttatttttaaaaatgagtagagtggtgttttctagctgttagtgtttccaaatatcaatgtagaaattagccttctgcagctgcagaggcaattcagtttgcagcttgcttgcatgtggcctagagccacccagcctgatatgtactaattttttgtttaacttgccagagtagaaactcagtttctgggccaggcatagtggctcatgcctgtaatcccagaactttgggaggccaaggcaagcagatcacaaggtcgggagttcaagaccagcctggctgacatagtgaaaccctatctttgctaaaaatacaaaaattagcccggcatgctggcaggcacctgtagtcccagctacttgggaggctgaggcaggagaatcacttgaacctgggaggcagaggttgtggtgaactgagatcatgcccctgcactccagcctgggcaacagagtgagactccatctcaaaaaaaaaaaaaaaaagaaactcagtttctggttacatctgatctttattttttatatatcatctaagctataaagttatattccctatttgtgatcttaaaagaaggactccaggaaagtgttcaaatattcatatatctaaactggaacatatgtttatatttttaaaagtagcctgagaggttggcaactaaagtcatatgttgaatgatcatttctcaagagtttcattttatggtctttctcttgttctgtaaaatgtgggcatggatagatataaagtgcctggtgtccatgcttttgtgaaatcccttcctcttccatgtgaatgggacctgtgactttcttctaacccagagaacacagcaaaaatgatgtgatttatctgagtccattgatgacattgattacgacttcccttcaccacattatttaggactgcgtcgtaggagactgggacacatatccactttgctggcttgatgaagtaaactgctaagttgaggaagcccacatggcaaggaactgtgggcagccttcagccaacaggcagcaaaaagctgagctcctcggagctacagcctcaaggaagttacttctgctaacaacctgaaaaagcttggaagctagtttctctctagtggaatttttagggaagagcatggcccaggcaagataaataatgtaagtggaaaaacctgtcaacaataaaggttttaaaggaaaaaac

SEQ ID NO: 27989 - DNA, 6318 bp, Homo sapiens
tccatgtcccagggcttagcatagcaaaggaagaccagccgggtcaccctggtggccatctgtccctgtcccacctgcagagtcagaacagcctctccccagtggggatcatctctctctgccaaaataacagcggtccctgccccaaccagactaccccactcagtggagttacggatgctgctccagcatcctaacactgcccagctggtgcctgcctgtgctcacccacaccccccaggccggccttccctgcagcctgggcttggccaccttggcctgattgagcactgaggcctcctgggcacccagccccatcactgcacctgctgcttccagccccaccccaccggctcaggggttcttcccagcggcgctgatcatgaagtcaacatgcacgcaagtcgtctcaggaaacttcttaatgaaagtgtcggccacggtggtgtgtaggtggctgagctcagattgcagctgctaagacaccagccacttaccaagagaaagccaggctgcttcaaacccagggcccacggcaaaaaagcatcacttccggccggggagtctggaagccacgccttgtgggaggtcacactggcatctaggccttcgcctgcattgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagaggagcacttttagaacatggaaaagtgtggtcatcccatcattagacagcacacatcctacataaataaaaagtcgtatggggaaggaggttggggagggaataaaaaattggcacagacattgatagactggtttccagtttcaaggtaacagatgcacatcatgagaccagaggaggcagagacaaggctggatttggcttttctaagcaacatgtgttcctgcgcagggctgaatggtcgctgagacagagatggaagccaggacaagggagcccaccgggcccagataggtacagagagcagaggctcctgttctgtcctcgccacccacgagggtgacactgcttgtaaatggtggctgtgctctcccagcaagaaaaaagcacaactaaatccacactgcacacagacgcagacagaaagccttcaagtggctctgttttctgctccctgccttgccaggtccacaagcagagaggagtgtcaggcacatggccccgctgtcaggctccccagtgagctgcgggctcagcaggagctgcccactgacacacaggggacacccactcctgccaccttgggagcggttgccagacagagccgcactgggtgctggtgtcatccagggactccacacacttccttaaatgtgatcctgcttccctctgcgcagctgcatcctctcctcctgcaggactgtctggaaacttggctctcagtttgctctcccttctctcctctgcctgccccaagcccctctttctaaaaaagtgatgccatgttcatggggttatttcttgaaaatacttggcggcctccatgcttctgttttctttgagccaggtggtcaggagggcttacaaagaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattagaggaccgaagcagagggtgctgtttcaacgccaccaccaggagagaggcagaggggctgtgccgtgctagagtcctcagggagggagtgacctcgaccctggctgtgctgcaagctgactccagccttggggtcagcagcacccggcgaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgacatcctggacaccacaggggcacctgcaggctgggagaccaggtcctctgtgcatgggcccgggaggcagacctgccctaagggtgatgcacaggctacaggtgctgcacgctccagcgcccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagaaatatggatggggagccctctggggatgggcaaggccttccaggataggctcagttttggtcccctgctttttgaggttgggttaaaattccgaccatggcagaggaagcacagctcgggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaagtacagcttcagcatgcctgcgatggcgttcacgtccatctcgctcatcatcactgacacgtccttgttatctggaaagagcacggaaatgcagcggcctccttgaagatcctgataaatgaagaaaagacacagagaaggatgtgacatgcctgggccatggagcactctgagatctcatcggggacaccactgcccacacctccatcccgtcctgcgcaggccgacactcactgacgttgaagcctgccttcagtgcctggatgtctgcggccaccccagacatgcggtagatgcccacctcctccatgcctcggcgctcgatctcctccatgcactggcgcacgatgtagggcaccttggacctctctctcctgcgggaggagggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcctcattgcatgtactttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaaaccctgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggcttatgtgggggagctgctgatggagtcctcgctgctcatgcccacagccctcccagagtgctatgcgagtggctgccgtgcagttgggggtggggcgtgtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaataggcttctcttggcaactgactcgtgacaaagggttcaagattgtttgaaaaaaaaaaaaggggggggggaacagggaggcagtaggtcctggaaaagtaaattctttattttacaataagaaagtgattacatattttattttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaagaagaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatggcacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcacgtggacagaaagagaaggaaagagggccctatatctggataacttggaaatgtgctccccctagcaagatatctaccaaaattaaaaccatatttgaggatgctggcactgcgagcaatatataaatgatgcatgtaacatcatttaatatgatcttatttttaaaaatgagtagagtggtgttttctagctgttagtgtttccaaatatcaatgtagaaattagccttctgcagctgcagaggcaattcagtttgcagcttgcttgcatgtggcctagagccacccagcctgatatgtactaattttttgtttaacttgccagagtagaaactcagtttctgggccaggcatagtggctcatgcctgtaatcccagaactttgggaggccaaggcaagcagatcacaaggtcgggagttcaagaccagcctggctgacatagtgaaaccctatctttgctaaaaatacaaaaattagcccggcatgctggcaggcacctgtagtcccagctacttgggaggctgaggcaggagaatcacttgaacctgggaggcagaggttgtggtgaactgagatcatgcccctgcactccagcctgggcaacagagtgagactccatctcaaaaaaaaaaaaaaaaagaaactcagtttctggttacatctgatctttattttttatatatcatctaagctataaagttatattccctatttgtgatcttaaaagaaggactccaggaaagtgttcaaatattcatatatctaaactggaacatatgtttatatttttaaaagtagcctgagaggttggcaactaaagtcatatgttgaatgatcatttctcaagagtttcattttatggtctttctcttgttctgtaaaatgtgggcatggatagatataaagtgcctggtgtccatgcttttgtgaaatcccttcctcttccatgtgaatgggacctgtgactttcttctaacccagagaacacagcaaaaatgatgtgatttatctgagtccattgatgacattgattacgacttcccttcaccacattatttaggactgcgtcgtaggagactgggacacatatccactttgctggcttgatgaagtaaactgctaagttgaggaagcccacatggcaaggaactgtgggcagccttcagccaacaggcagcaaaaagctgagctcctcggagctacagcctcaaggaagttacttctgctaacaacctgaaaaagcttggaagctagtttctctctagtggaatttttagggaagagcatggcccaggcaagataaataatgtaagtggaaaaacctgtcaacaataaaggttttaaaggaaaaaac

SEQ ID NO: 27990 - DNA, 485 bp, Homo sapiens
atggcccccggtccctggcctgtgtcctgcctgcgtggtggccccttgggcctcacatatttgtcccttctgctcatccctgctgcagctggaacctactgtgaatgcagccttggcctcagccgcgaggccctcatcgccctccttgtggtgctggcgggcatcagtgccagctgcttctgtgccctcgtcatcgtggcaattggtgtcttgcgggccaagggtgaaacatgcccgagacaagtggacaacaggttggtggagaattttggggtccaggaagatctcatggacctgcacccggtttacgtggagtcccagctaatggacgctgacctggaggtctccctggtgccaccactagaggatcagagccttgtggccatccccatggaggcttcttcagaggagccgccaccacccccgcccctaccacctgagtagagggctgagggcagctgggggaggggaattaaagcgtattt

SEQ ID NO: 27991 - DNA, 6751 bp, Homo sapiens
attgagcagtgctcactggtatttcgctgatgtggccccaaccccgcctccctccccaccccgcgatgtcagaaaaaacacaacaggggaaattggccgcagccaagaaaaaggtaaaacacaccaggtcatggcccccaacccagccacagatcccctccgatgacaagacctgtgccagagtccataccactcctgaggcataccagatggggccccccaaccccagcccctctgggctcccccaaccaaagcctagtcagtcagccccaccccttcagcaagcagcccagtccctgcccttgccaatcaccccagggtgactttgggcaggtgactcctggggctccctgctccataatcagctctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccagcctttgatcttacaacccagtcccctaagttttctcaccccatttctggttcctctggttgcagcacaaatttccagctggaaggggagtggagactatgggacctaggagcaagaggtttcaggctgccttactcccttaacatagacattgacagtgggaaaagcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgcgggacatctttctgaagcatcattttcccttgattctcttgagaaaatgcattaatgtacttgggggtgacagacacataggtttccaagcgtataccagactttgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtgtgcttttctacctctgcccctggttttggtccctggaagctgctgattcatggcaaaaccccagagcgtggagtcagaggactgagtttaagttccagtattgccttttttgatctttcttttttttttttttctatccatgatatgaatccctctcagtcactgattgtgacaacaccttgtacggttgttggtggcattacatcagatggtatataagggtattttgtcaaaactgtaaaggaggatgtggctgtaggggctgatcattctcatgagtgttactgctcttctttcccacagttaaaagcatattggcagaggaagagccctggcattccagcaggagctaacaggaaaaagaaagtcaatggcagtagccctgacacagccacttctggtggttaccactcacctggggatgtgagtctcggcgggccaggctcctggggacagggggcccaaggggcagtagagggtaattgttaagattgtagatggactgttgggtactggttaagaattctggatttgaatcctgcctctccgtctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacactgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatggggaaaagggtccaagataggcagaaaagaagcttttgccagttgatgggggaagaaaggaagtcagagggcttagacagtgaggggggacagaacatctccatgtgcactctcatctcttgcagtcagcaacaggtatctacggggagggccgtgcatcctctactaccctgcaggatctggaggtaagaggccctgggccgaggtgcagtgaccctgcaggccagccctccaacctcctcccacagcaggggcttgttgcccctctgccagctgaggcagcccacacacccccaccagccctaatgattattctctctacccctcgccacaatcttcctccaactccttctctctgcatgcacctcagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacgtgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtcaagaaattgaaaaaaaaaaaaaacaaaacatttaaggggttaatatcctacacaattcatttacttcatttgaatgttagagccacttatgtttatttgtgtttctaatttatagtttaaatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccaagttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaa

SEQ ID NO: 27992 - DNA, 4214 bp, Homo sapiens
acaacccagtcccctaagttttctcaccccatttctggttcctctggttgcagcacaaatttccagctggaaggggagtggagactatgggacctaggagcaagagttaaaagcatattggcagaggaagagccctggcattccagcaggagctaacaggaaaaagaaagtcaatggcagtagccctgacacagccacttctggtggttaccactcacctggggatagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacgtgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtcaagaaattgaaaaaaaaaaaaaacaaaacatttaaggggttaatatcctacacaattcatttacttcatttgaatgttagagccacttatgtttatttgtgtttctaatttatagtttaaatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccaagttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaa

SEQ ID NO: 27993 - DNA, 5339 bp, Homo sapiens
acagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggtaagagtccagtggggtcccctgattacagctggtcaatcctggactccagtttcctcttggggccctgaagaaaggagctaggggcccctgatgccaagggcaaatggggagctgggcacccaggtctcacctggagggaccccagagcacagaacatgcagcatgggtcttctgcactgccctctttgctgactctctcttctccagacacccctgctctagtccttgccacacatgccctggggttgtcacctctctgggaagcactagcctgactggttgtcaggggtccatatttctgccctgcctcagtccctaatttgctttttgagtctggacaagccatctctcctctttatgctcgtgtttctggaggaggtagagagtatcaaaggtcttggttagctctgaaagtcagagatttaaaggcccctagaatggaaacctcagggccaagggctcctgtctgtcctttgctgttttatatctctgctatgaagaactgtacctggcctgtacatgctcagtaaatgtttgttgaatgaatgcacgtttctaaatcacaaactggcagaaggggggtgggcctttctcaaactctgtctctggacgttcaccagcccctccctccagggcccttttccccctttgctttgggcaggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgtgtgaacaggaggagaggctacgtgaacaggaggagaggctgtgtgaacaggaggagaggctacgtgaacaggaggagaggctacgtgaacaggaggagaggctacgtgaacaggaggagaggctacatgaacaggaggagaggctacatgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtcaagaaattgaaaaaaaaaaaaaacaaaacatttaaggggttaatatcctacacaattcatttacttcatttgaatgttagagccacttatgtttatttgtgtttctaatttatagtttaaatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccaagttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaa

SEQ ID NO: 27994 - DNA, 983 bp, Homo sapiens
atgagtgactactacatggttattagagtggcaaacaaaacagaaaaagaaacaactgctgcccctcctactaatactgagacagccaggtgggaaggggtccctggagaaactccaattagcctgcccactgaggtggagccttgggaagttcacaaggtttgcagcagagagaagcctgagcctggccccagtttttcatttgtagaacctgggattcaaactgtcaggtgggaagcgctccggcggaaggactctggccctgcaagagctctctcgcgcccaccctgccccgagctacggagccccttccggtcccgcggactccaagcctcaagtttccgccacaccctccagagaagcgtccccgccgcagccccggggggcgggaggcgcgaggcgcggctgcgcccagcactggccccacctcccacgcgcccgcgggagatttgcttggggctggatcccccgcctaccgtttccccgcagccgccggcgcttctggcgcttgtgacccgagcaggaagcccagagagaaaccagaaagacaggaaggggattcctggacttcctttccacatccggcaggaacgcgaccctcctccagctaggagcgcttgtccgggcgcaccaagatgcctgcagcttcaagaagatgtatgggaacagacacagaaactttccctaccagataagcaggacaaagaaacacagactaagagttggcctgtgtggtcacggagtgggttaagagatgataaaaaaatctgctctgtacagatggcacacctggtcccaactaaaccctggggccctagaaagataagacatcccctcctcacaagcccctcctcaagagccccctcctcaagagcccatttataaaaactctgacattcttaactacaacttggcaatcttctcaggatccctctctaacagagacctgttctttccttttgcctattaaactcctgctccaa

SEQ ID NO: 27995 - DNA, 4140 bp, Homo sapiens
ataaatggtaaaatgttaatatttgagattcttggctttttcttacattattctgtctttccttcttaatttttaattgttactaagagaaagctggtcacagtacactataatctcagctactctggaggctgagccaggagaatcactggagcccaagagtttgattacagcctgggcaacattgcaagatcccatatctaaaaaaaaagcaagcaagcaagagaagcagcggggattttaggaggtgcttctgcagaaaccagtcgtttatatcatcttcaacaatcctggctcttgctgaagtagactaggggcttccccgaggggcggctccacctcatgctgagacctctgcatgccttgggggtggaaatatttgatgagactcccaggggtccttgggaccttgggctgtgaggaccagaaggattagaggactgtgccccttctccccactgtagatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcatgcgccagtgcgtggaggagatcgagcgccgaggcatggaggaggtgggcatctaccgcgtgtccggtgtggccacggacatccaggcactgaaggcaggcttcaacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccagttgcaaggaagagctgcatgctcaacctgttgttgtccctgccggaggccaacctgctcaccttccttttccttctagaccacctggaaagggtggcagagaaggaggcggtcaataaggtgtccctgcacaacctcgccactgtctttggccccacgctgctccggccctccgagaaggagagcaagctccctgccaaccccagccagcctgtcaccatgactgacagcaggtccttggaggtcatgtctcaggacgaggtgctgctgtacttcttgcggctggaggccatccctgccctgaacagcaagagacagagcatcctgttctccaccgatgtctaaaggtcccagtccatctcctggaggcggacagatggcctggaaacctctggctaatcgggccatctgtagagtgggaatcaagattttctgaggcatccttgggccacccccaggtgtcaggccatctgccaagagacagcggcccaaagcagaaggacaggtggcctgggcagatcccgcccaggtctgaaagccccaggctggcctcagactgtgggttttttatgtggccacccgagggcgccccaagccagttcatctcggagtccaggcctggccctgggagacagggtgaaagcagtggtttttatgaacttaacttatagagtccaaaagatttctactgaatcacttgtcaagaagcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttggtcagcactgggtagcgttttgactccattcttggctttcttctttttctttccagaaggatttttgtgcagaaatgggtcttttgttgccgtgttagtcctccttggaaggcagctcagaaggcctgtgaaatgtcgggggacaggacccccagggagggaatcccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcatcttttgtataagtctccacttggtggcagcagcttgctgatgacttgttttaaaactttcatcctaaataaccttttgatacttgaatatttttaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataatcccatgaacatggcatcacttttttagaaagaggggcttggggcaggcagaggagagaagggagatcaaactgagagccaagtttccagacggtcctgcaggaggagaggatgcagctgcccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccacagctcactggggagcctgacagtggggccatgtgcctgacactcctctctgcttgtggacctggcaaggcagggagcagaaaacagagctacttgaaggctttctgtctgcgtctgtgtgcagtgtggatttagttgtgctttttacttgctgggagagcacagccaccatttacaagcagtgtcaccctcgtgggtggcgaggacagaacaggagcctctgctctctgtacctatctgggcccggtgggctcccttgtcctggcttccatctctgtctcagcgaccattcagccctgcacaggaacacatgttgcttagaaaagccaaatccagcccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccacagggtcccagggctggtggttgctttgggtctacagctacgtcttacccgcctcctgcctcaacagcctgtgtggtggcaaagccggtgtggggctggggaacgcagcgttctccaggaggggacccggctctccttctgcagtgcaggcgaaggcctagatgccagtgtgacctcccacaaggcgtggcttccagactccccggccggaagtgatgcttttttgccgcgggccctgggtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaaccccagagccggtggggtggggctggaagcagcaggtgcagtgatagggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaactccactgagtggggtagtctggttggggcagggaccgctgttgctttggcagagagagaggatccccactggggagaggctgttctgactctgcaggtgggacagggacagatggccaccagggtgacccggctggtcttcctttgctatgctaagccctgggacatgga

SEQ ID NO: 27996 - DNA, 436 bp, Homo sapiens
tgggggcgccagagcaggaccggagcgcgggccaagctggagatggatgatgctgaccctgaggaaagaaactatgacaacatgctgaaaatgctgtcagatctgaataaggacttggaaaagctattagaagagatggagaaaatctcagtgcaggcgacctggatggcctatgacatggtggtgatgcgcaccaaccctacgctggccgagtccatgcgtcggctggaggatgccttcgtcaactgcaaggaggagatggagaagaactggcaagagctgctgcatgagaccaagcaaaggctgtaggccccactggcccaccacagctgccatgccaccctctgcccgtatgaagaggtcactgggggatggagctggcacccacatgaatagctgtatgcactgtacttgtttcttaataaacttattttta

SEQ ID NO: 27997 - DNA, 926 bp, Homo sapiens
atgcacacatcttctccaaggtttgtgtgcagaacatcctgcccatgctgccccagcagcttcagttggcacctgccccagtccagcctctgggaaccacgcagcagctcccagcggccctgcacccaccaccagcatccgtttcacctgcagttgaagatccgtgaggtgcccagaagatcatgcagtcatcagtcccacggagcagcccgtgaggctgaggctcctcccactggaccgccccccgactggcaccactgctgcccctgcccctactctcagcctcacgtgactctcgggcagaggcagtggtggggcagccagggcagcgtcaagagtctgagccagctgcaggacaaattcgagcatcttaaaatgattcaacaggaggagataaggaagctcgaggaagagaaaaaacaactggaaggagaaatcatagatttttataaaatgaaagctgcctctgaagcactgcagactcagctgagcactgatacaaagaaagacaaacatcctgatccatatgaattcctcttattaagaaaaataaagcatccaggattcagtgaagaactgactatcaccttgttaatcattcagaaacatgttgcagacttaagccatttttgatatagatactgaaacaattacttgctaagagcaaacttgaaggtatggataaggccctgagtcatcttgctgagctgaatgatagttaagctgaatgtacgtataaaatatgattttctaaccacttgctcgccaacaaggaaaacttttaagtagagcagaacctgaatagacaagacatttctttcttttggtagaaaatgatttaccatcactgtctagttaattgtagactaggtaattttaactttgtgatttattgccggagacattttcttctgtactataaagtg

SEQ ID NO: 27998 - DNA, 2194 bp, Homo sapiens
atgggaaataagtatcttcaaagaactggagttaatttgaaagatgcatataaaggatccaatgccagaactccgctgatacttattcaaactcatgggatcgaccttaccaatatcctcctgagatttgcacaagagttaaaaggaacaacacatcatgtgaccataatttctctgggccgtgaccaagcagctaaagctgaagacctcattttaaaggcactaacaaaaacacaacaatgggtcttcctccagaactgccatcttgcaacatcatttatgccaaggctttgcacaattgtagaatcttttaatagtccaaacgtgacaatagaccctgagtttcggctatggttaagctcaaaatcatacagttcttttccaattcctgttcttaaaaagggtttaaagattgccgtggaatctccccagggattgaaaagtaacttacttcagacatttggatgtactgggagtggagaggtaacagaagagatatttgaaaatcctgactgtggacaatggtggaaaaaacttttatttagcctatgttttttcaatgctgtaatcaatgaaagaaaaaattacggaatattgggctggaatattgcttataaatttaattcttcagacttgggggttgccattaaggtgttggaaaattccctgagaggacagcccagcatttcgtggcaagcactgcgctacctgattggagaagtgatttacggtggccgggtgattgataattgggacaagcgatgcttgaagaccctactctacaaattttgtaatcctgaagtgctgaaagatgacttcagtttctccagtgatgggatatgtctgccagttccaggatctgcaagcataaaggactacatacacattatccagtccttacctgatgatgaccttcccgaggtcttaggaatacacccagaggccatcaggagctgctgggagacccagggcgaaaagtttattgaaaatctgattgccatgcaaccaaaaactaccactgccaacctcatgatcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatttaactcttttcttaatatgagagtgcctacattgtggcagaaacacgcctacagatcttgtaagccactgagttcctggattgatgatctcatccagcgactgaatttcttcaatacttgggccaaagtggcttatactgcaatacagcgtcggtatatgagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataaatgtccatatcaaaccatt

SEQ ID NO: 27999 - DNA, 374 bp, Homo sapiens
ctcaagttcaccatgagccacagcagtaagccatgctttagcctctgacctgtgctccaattttggtacaatgatttctgccatgttctccaacagggtgaggaaacagacagcactaagagaaaaagctggaactcaaaaccaaattaactccaaacttaagttttcccacttcgacaagaaaaggaactgcatgtgtttttctgcctcttgcagatgtatgtcataaaagttggatgccttcctttcaagacatttgaatggatcaccaaataattacctacttttctctcacaactcagataaataattaaaaggagatatacacagattggttgcatacttaagagtgagaatcaattaaaacaaaattg

SEQ ID NO: 28000 - DNA, 6839 bp, Homo sapiens
cctcatcctaccaagtagtagggaccacaggtgtgtgccacccaggtcttgctatgttgtccaggctggtcttgagctcctggcctcaagcaatcctctcaccttggccccccacagtgcaaggattacaggtatgagccaccatgcctggcccctaccctgcctactgagaaccaaaggaaggatccaaattctccttagctcaactcgagccatttcctgattgcttcatcagcgaggagctggttattgggctgtccaggcctcccaagcagcacagaaatgaggtgaaggagttttcctgttgctccactctgtaaggagttggagggtgatgtttactcgtttgcagagagagatgccttgtaggcacctcaggatggagagggccctgattccaatgtcctttttttcttcagaaacaggaccttgccctgtcactcaggatggagttcagtggtcctatcatggctcattatagcctcaaactcccaggctcaagcaatcctaccatgtcagccttcccagtagctgggactacaggatgtgagctcacaatgactcaagctgccacatactgttgattgtgaaatgccagttgaagcatatgtcctgcgagcttaggggtgctacaagttgaccactgcagcagtaaagatgactctgaagaatggcgtgggttggttcctttcaaatgcacttgagcagcggtctccaaccacagggccacagagctggagctggatctaccatgaaagacttgtgaatccaggaagagagactgactgggcaacatgttattcagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatcgaggttgcgctgtccttatgagaatctaatacctattgatctgttactttctcccatcacgctcaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28001 - DNA, 780 bp, Homo sapiens
atgtgcctgtattgctgggacatcgagccttcccaagtcaaccctgaaggaccaagacaacatcatccttcagaggtcactgagcggcagcttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaatatccaagctacaggctctagaattttattaaatgccatctctcactaccatatttttctttcctgtggtaaacttgaaatttgctgcttttcaacaaataataatgaatatgtataggtagacttttgaaaaatattattctcatttaaatttttgcaaatgttttatgacatatttagatgtttagaagtatgttataataatagaacaccagatttcctctgctgtatatttataatgacttccatttaaacaaaatgtttaaatactttaaacagtcctaggagactgttattataactaactcctgtattttgtgttgctattgcagataagccatagtgtaattaaaatttccatttaaggtaaaatttgaatattgaattaaaattttacttttaggtatgaaataaattataattat

SEQ ID NO: 28002 - DNA, 780 bp, Homo sapiens
ctaacggggaaacatcctccgagaagatacaatctcaagggtgggcctggatgtgggcttccagagaccatctccctgaaccagatcttggggatgcagcgccccctggctcgccttcatcattctggacatccgggctcccgagacaagagcgcagcacgagtcgccagcgctcccgaggctccccttcgagcacctgcgtgccctacaaggtccacgccctggcaaccttcgagtgctcggctacgagccatgccagccgcctgtggcagacgctgcagcagttttgggccgatcacatctcgcggcccttctcgccacggcggccgccactgcgccgcatgccctccctgtccaccttctacctgctggaccacaacacgcgccaggccgagctgggcctcgcctacggcgcgccgtgcatgcgcctcagcaaccaggccttcgtgttccgcggcgggcggtggaccactgagagccagctggcgaggacgcggtcgccgctgctctcgcggaccgcctggggctggaaggcgcaggtgcagcggtccaaaagccaagtgttgctggaggagaacaactacctgaagctgcagcaggaactgctcatagacatgctgactgagaccatggcgcgcatgcacttgctggagaagcagcgcaaccccgaggtgatcccgacggctgcggcgcgcgccgggcagaggaagatgcgcaagcgcgcaggcgccagcgcgggcgtgctcatgatccagccgtgcgctctggactcgcagtgac

SEQ ID NO: 28003 - DNA, 1913 bp, Homo sapiens
gaaccccaggaaaggacggaacagaacaggacagggcccccagccccatctttatctcaccggctgctgctggctgccaagcctcccctgaatgggggagggtggtctgtgtgagtcagcggaggcacgaagtggaggaagacgggagcctctgccaggcccgttgagcgtggcctcagaaatgcgccgctgggttagggtctccccgaccgaggctcgaatccaggtcgaagggtcgccggagcgatggttggagaatgtggaaggagctggaggacacccgagtattcttaaagcaatccccatggccaaaatcaacagctgatctggataccatcaagacacctgaaatcttatcatgagccagatgctgaggaagagactccgggaggatcccgaggacggcccagttgcagccatgttgagactgacgctgaggaggaccccaactgtcacgagcaacacctgtcgaacacagccacccacctggggacagatcaagaagctgtcacagatggcagaagaaaacctgaggaaagcgggacaaccagtcacaatgagtaatttcatggtagctatgatagcagttatcaccactgctgtgagtattccttcaacaagggctgacacacagaacaattatacttattgggcatatttatcaaccttggctggcaataatgcctagatgtaatcactctatgacacagttacacatgctttctgatctcagtatttaccataatctgctcctataattgaggcataccgcccttaaaaacctatttgtaaacaaaattgaacctggccagaaaaaatgaacgtacttgtttaggaagattgcattgcagaacaggcagaggtgctgcgcaacgattcctatggaatcactgttaattggtcccctaaggggatgtttagcttaaattgcacctctcagcctgcgtgccacggccacactatgtgcagctggtctgaacaaaacggtcagatggtagaaacaataagaagtatggcaaaagttcctattatctggaaccatgctggtatagtggcacctcaacctcaaacgataaggcccgctgtaggagctaaacattaaggatttgtagaaactattaatagctcttaataagatcaaaattggggaaagaataaagcatctagaaggacactctacaagctttttggatacagtaaaattaaaagaaaaaatatttaaagcatcccaggcacacctgaccttaataccagcaactggagtgcttaaaggaactgcagacagatttgcagctagtaacccattaaaatggataaaaatacttggaagctctgtaatttcaatgatgtgattgtgcttttaatctgtgttgtttgtctttgtatagtctgcagatgtggatcctaactcctgcgagaagtaactcacagtgacaaagctgcctttgcttttatcgagttgcaaatcaaagaaggggggacatgttgggaacaggccccccaagatctggccataaactggccccaaaactggctataaacaaaatctgcagcactgtgacacgttcatgatggccgtgacgcccacgctggaaggttgtgggtttaccggaatgagggcaagggacacctggcccacccagggcggaaaaccgcttaaaggcgttcttaaaccacaaacaatagcctgagtgatctgtgccttaaagacacactcctgctgcagataactaaccagacccaccactttacttcggcccatcccttcatttcccataagggatacttttagttaatctattatctatagaaacaatgctaatgactgacttactattaataaatatgtgggtaaacctctgttggggctctcagctctgaaggctgtcagacccctgatttcccacttcgca

SEQ ID NO: 28004 - DNA, 621 bp, Homo sapiens
atgccgaccagttcttgcctctcccagaacccaaaagcatcatcccagcccttccatggctgtactgacacctatccctgggacaggctttacctttcttctctgagatgtcagatctttcccctacagacagggtggaaaagagagccggcgcagcgacacttcttctccaagcacgacaaccgtacttcctttgacaaagagggtccctattgcctgctgcagggaatcggaaggcggaaggacctggagcgcctgtggcagcggcacaccttcctgcgctgggcaccctgtgagatagagttgcgccagcaggggcccctggaatcttcttaccaggctgatttcaggccaggcccaggactcagtggcctcccccagcacctcatccactttgtgcaggtccagccttcccataccaggaccacctaccagcagaacttctgctgcccatcccagggtggccactatggcagctacaaggtagggccccaggcgccggtcactgacgtactgcctgacctcccagggatcccaagacccaagctgctgcagcactaccttcatgctggggtctctgagtgtctaaactggtccagagcattaaacaaggacagctga

SEQ ID NO: 28005 - DNA, 595 bp, Homo sapiens
atggcatgggctgatctacccagtcagcaaggccagattgcagagaaactcagagtctaggaaaatgaatgtctaggaacattcctcaaatagtcctaccagaagacacaaagatgatgcatccggatgaagaatatatcactgagattaatggccctgggttgcagccaaaagcatctcagaggtagaacactgttgcagatggtgatgttaccatttgaaaggtatgatgcatttcctgactgtggtcggctttccatgggtgaaacagaaaagtcttcaaatatcctcaccaactgctttcctagatttttcagccagttacttgaccatattaggaaaagaaaggtgagcttgggcttcaggacatagaaaacaacattagttatgctggaaagtatcaccaaagaagtgcagctcagacaagctgtattctattttgttcttttgaacataaacacctataaagggaccaaaagaaatctaaatgatcaacgggagcaatcctgaataggcaacaacaatcattattgccaagtgattgtcttatcatttgtcatcagtttttttttcagagtaattacatttaaatgta

SEQ ID NO: 28006 - DNA, 799 bp, Homo sapiens
acaagattttctgaaagactgctatggagtctgagaaaaaatgtcaaagattgaggacatgaagaggaaagaactgacagaggaggtgaagaaaggtgatcaggaagagccatcaaagtgttatcctggaattcaagtgaagacagtgtttcaaagtggaaatgaacagtgtcctgtaaccctcagagtgagactagagtcagaatgcaggcttttctcatttgaaatctcaaggtaagtccaggtccttacctccacctaaaagttctgccatcaaggaacatctgctcattatcttctgttcacacatcaaatgacttcaatgtgatccctggatgttctccaaagagctgaagggaaataaatattctttctttatcaccaaatacttcaactgcagagtgattgtgctaccaaggcctgaaacttcggaaaaacctgcataacacaaaatataaaatatgccacagagaggatccagagagcccatctccggtcagttatctgtatttgtatgtcaactacagcatcaaaaagcataggcatggatactaaggaccccctctgtacaccaacgccagtccaaaggacagtgtgtcactgtgaactggaaattcatctctcttcttcaatttttttctacctactttatgttttatctctaagttgaggctgtttatggcctcatcctcaattaccttgtccctcattactcccagttaatggagattaagctttgtatcatgacttcctaactaaaattgaaatcacaagacatcacataaataaagttacaaat

SEQ ID NO: 28007 - DNA, 4713 bp, Homo sapiens
atgtcagaaaaaacacaacaggggaaattggccgcagccaagaaaaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccagcctttgatcttacaacccagtcccctaagttttctcaccccatttctggttcctctggttgcagcacaaatttccagctggaaggggagtggagactatgggacctaggagcaagaggtttcaggctgccttactcccttaacatagacattgacagtgggaaaagcctacacttcccctgtgagctcaaaatgttcacattaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgagcaggaggagaggctgtgtgaacaggaggagaggctgtgtgaacaggaggagaggctacgtgaacaggaggagaggctacgtgaacaggaggagaggctacatgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtcaagaaattgaaaaaaaaaaaaacaaaacatttaaggggttaatatcctacacaattcatttacttcatttgaatgttagagccacttatgtttatttgtgtttctaatttatagtttaaatttatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagctttcaatttgcttagaaggcaatattagaaggttagagttcagcagaaagagagaattttaaaatgtgagttcgactgaataaatttgaatttctgtaggaagtaaagaatcaaaatacctatttaaagactgcaatatatgataattatttttaaagtaatagattaaacctgataggttttcctgaaatgaaaaacaatcagttctaaaaccaaagctgatttttagaaaatgtgaaaatgtaaatcaaccctatccaaaatagattctctaaaactttatcttacagtcactttcaaataactattcaaaaatgtaactgttaaattaatgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaataaattattagattgtttcaaggtgctgttttgcctaaaaattttgtgtgtcttgaaaactatagtattaaaggtattgagactgtgcaaatgctgggcatgcttggcatgagataatcggtttttattcttacaaaattgtaaccatgtaagtgtgtttattaaaagaacacaaactaaaaa

SEQ ID NO: 28008 - DNA, 4282 bp, Homo sapiens
acagctgcctggtaggtgactggaggcattgagcagtgtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaaatcaatggcagtagccctgacacagccacttctggtggttaccactcacctggggattcagcaacaggtatctacggagaaggccgtgcatcctctactaccctggaggatctggagagccagtaccaagaactagcagtggccctggattcaagctccgcaataatcagtcaactcactgaaaacatcaattcactggtaagagtccagtggggtcccctgattacagctggtcaatcctggactccagtttcctcttggggccctgaagaaaggggctaggggcccctgatgccaagggcaaatggggagctgggcacccaggtctcacctggagggaccccagagcacagaacatgcagcatggctcttctgcactgccctctttgctgactctctcttctccagacacccctgctctagtccttgccacacatgccctggggttgtcacctctctgggaagcactagcctgactggttgtcaggggtccatatttctgccctgcctcagtccctaatttgctttttgagtctggacaagccatctctcctctttatgctcgtgtttctggaggaggtagagagtatcaaaggtcttggttagctctgaaagtcagagatttaaaggcccctagaatggaaacctcagggccaagggctcctgtctgtcctttgctgttttatatctctgctatgaagaactgtacctggcctgtacatgctcagtaaatgtttgttgaatgaatgcacgtttctaaatcacaaactggcagaaggggggtgggcccttctcaaactctgtctctagaggttcaccagcccctccctccagggcccttttccccctttgctttgggcaggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggagaggctacatgaacaggaggagaggctacgtgaacaggaggagaggctgtgtgaacaggaggagaggctacgtgaacatgaggagaggctgtgtgaacaggaggagaggctatgtgaacaggaggagaggctacgtgaacaggaggagaggctgtgtgaacaggaggagaggctgtgtgaacaggaggagaggctgtgtgaacaggaggagaggctacgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggaggagctcctggagcaggagaggcttcggtaacaggatgagaggctgtggcagcaggagactctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtagctggagccccagtcccacaaggagcttggatgtgcggacaagcagggtggactccccaggagcacccaggcttgggtggagaagctgttggtacaggagaggcggcaggaggagcaggagaggctgcatgccattcttttcgggctgccgagaacagggagctaaacatcaccatcatctaagagcgggtcaaggaattaaaaaaaaacaacaaaacgtttaaggggttaatatcctacacaattcatttacttcatttgaatgttagagccacttatgtttatttgtgtttctaatttaaatttatttgtttctaatttatagtttaaatttatttgtaaaaagttaaatgagagtgggtctttctctcatgttcactctggcatcctttagcattttttaaatttgataattataggacgttagcatgcatatcgagtttgcccttatgtggtgggagttcaaacacacaaagacccactgtatgcacacaactgttcttgctggtttgggataggctgccatgctttttaaatgttagtacagcatgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagccttttcccctttttctgtgtattggggatgggagtaataacattttggggagctttttaaatctcccagaagaggaaagtggcctgctctggcaggtgtgtgcaggatagaatatgtttcatttgttctggtgccaagaatgagcgctgtactatggtagttcccttaggatttgcatgtgctctgggctcatgaagacattgcatcatgagctgtggcagttgtacttttttttgatgacctaaaaggggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcattctccttaatgtattcagtaaagatcagaagaaatcctttaagagtttaaatgtccctgaaacaggcatatacaggctctagtcaagaatgaattcgagtgaaggaaagctgtgttacacctggcattcctctgtgttcatggagcttatttgaggctagaagatggattttaccatctagacctctctggctaatagctagtcttcaaccatctgacagaggaattctttttcttgaatggaaaaggctttaaaaataataacaaacattattataaacaaatatatgtgagagtacttagttgaaacaaaaaggaattttagtagacagtattatactacatttgaaaatcaaggagcagtttatgcaacttaaaatgtttacaaactgcagcgcaatctactgtttgtgaatgtcaaagtgtcatgaggaaagtgtctatacaatcacggagttatatttcctcacaaagttctttacgaagagtgaaatatgtttttataccttttggtttcagttagaggcatattttgtgtaatatttatggtttaaaatggacttaaggtcctgttcttgccttttattttctgaacttgctgcttttgcattctttgagttcagtttaaagacagttcctttaagtccattttaaaccctcaggctagaagtcataccactgttaattagccacattatttgatctaacagtttttctttatcattctgaaactgggtttaccgaatacattgataaattatttcaaaggtatttttatagttcaaatcacttcacttttaccctgacacgtataaatgactaggaatgaccttcggatagcgtttagcatctgtaaccaatctgacaataatgtgttcatcaggtacctatggattaaatcacatacaggcatatttaagctgaacgtcagtctgaaaaataaatgtactatattaactgaaataccactcttcatgtaggtattttgtcata

SEQ ID NO: 28009 - DNA, 780 bp, Homo sapiens; identical to SEQ ID NO: 28002

SEQ ID NO: 28010 - DNA, 1513 bp, Homo sapiens; identical to SEQ ID NO: 27980

SEQ ID NO: 28011 - DNA, 970 bp, Homo sapiens; identical to SEQ ID NO: 27981

SEQ ID NO: 28012 - DNA, 1246 bp, Homo sapiens
tcaggttgaaatattgttacaggaagaaattagagatccattttgtctttgttaacagatctatatccctggccctttatatcctgtgtagcaccattttgtaggtagtggaaggtctcaccttattctgtaaaatcccatgtcatctttcccaagttgtagtgggttccaacttgtggttgtcccctcaagtgattcttttttcctaaaagtaaaaatctcccatgctacttacatctctacctcgagtttttaaaatattttcaaatgctgcatcaccatgaagccatacaatagactttattaaatctcaagtaagttggttagatttaacagagctaagcctcatccatcactgatcagtcttcacatataaaagtaaggatttgtgctggcttcagtggtacatatagtaaaattgaaacaacgttgagaagatcagcatggtccccacacaaggatgacatagaatctgtaaagtgttgcatatttcttgcagtccccaaaaggacattttactactttctaactagctccaaggaaatggtcattgatcaacaacttttggaatataaacaaaagatatctaaaaattctcaaaatagcaatccagaaggaacatgtgaaggaacacctgatgaggctgcacccttggcggaaagaacacctgacatggctgaaagcttggtggaaagaacacctgatgaacagcatacagtgagttcctcttcagagattttagcctgtaaaaatcctttaaaattcaagagggggaagattaagtacaacgagttctgagttcctcatcaaagagcaaatatgtcagtatgttcagattctctgttctttgttctccgttttaaagtttaacttcctcgttcgttatgcctccttgcccctagtttcattaaacaacccccttctagcctctaacacctgttttgtctttagtcattcttagtcacctgctctgtccttagtcatccttagacacctgctctgtaactgtctttccagctgaaactactcaccctgccactccagctcatacccctgctctctttgaagtagcccatctgaattagctaagagtgtgcagtccaaccctatccaatagggaaaagacacaacagtagggactagctgcgttaggaataagaacactttcccttcccttgtccggtgtgatcttgccattgctccatctgcaagaccactatttcatagaagtaaatttgccttgctg

SEQ ID NO: 28013 - DNA, 3922 bp, Homo sapiens; identical to SEQ ID NO: 5434

SEQ ID NO: 28014 - DNA, 799 bp, Homo sapiens
acaagattttctgaaagactgctatggagtctgagaaaaaatgtcaaagattgaggacatgaagaggaaagaactgacagaggaggtgaagaaaggtgatcaggaagagccatcaaagtgttatcctggaattcaagtgaagacagtgtttcaaagtggaaatgaacagtgtcctgtaaccctcagagtgagactagagtcagaatgcaggcttttctcatttgaaatctcaaggtaagtccaggtcctaacctccacctaaaagttctgccatcaaggaacatctgctcattatcttctgttcacacatcaaatgacttcaatgtgatccctggatgttctccaaagagctgaagggaaataaatattctttctttatcaccaaatacttcaactgcagagtgattgtgctaccaaggcctgaaacttcggaaaaacctgcataacacaaaatattaaatatgccacagagaggatccagagagcccatctccggtcagttatctgtatttgtatgtcaactacagcatcaaaaagcataggcgtggatactaaggaccccctctgtacaccaacgccagtccaaaggacagtgtgtcactgtgaactggaaattcatctctcttcttcattttttttctacctactttatgctttatctctaagttgaggctgtttatggcctcatcctcaattaccttgtccctcattactcccagttaatggagattaagctttgtatcatgacttcctaactaaaattgaaatcacaagacatcacataaataaagttacaaat

SEQ ID NO: 28015 - DNA, 675 bp, Homo sapiens
atggtcgatgatgctggtgccgctgagtcccagcggggcaaacagactccggcccactccctggagcagctgcgtaggttaccacttccgccgccacagattcgcatccggccctggtggtttccggtgcaggaactgagagaccctttggtgttctacctagaggcatggctggcagacgagctctttggcccagaccgagccataattccagaaatggagtggacgagccaggccctgctgacagtggacatagtggactcagggaacctagccgaaatcaccgttttcgggcggccccgtgtacagaatcgggtgaagagcatgctcctgtgcctggcatggtttcaccgagaacatcgtgcccgagctgagaagatgaaacaccttgagaagaacttgaaggcccatgcatcagacccccactctccccaggatcctgttgcttaagacaacatagttactgttgggaacatcttaactttctaacttttgctgctaaagttgaagaaaagcaagtatagcattcttaaatccccgtattcctttttcctgtgtcttgatggattgtggtttattttgttgcaagagtgagtttgaactattctaataaagaaatggctattttgccaaaagcattaagatcttcacacacttataataaagcaaatttat

SEQ ID NO: 28016 - DNA, 417 bp, Homo sapiens; identical to SEQ ID NO: 27982

SEQ ID NO: 28017 - DNA, 361 bp, Homo sapiens; identical to SEQ ID NO: 27987

SEQ ID NO: 28018 - DNA, 1737 bp, Homo sapiens
atggcaatctggaaaaggggcaatctgagcagagaaagcagccagtgtcaaggctctgagcagccagaatggctggactggagtgtggctatgagaagaattggagtttatatgctgatgggaatgatccattcgaaaggggaaaatgatgaaacaggaaagagagaaacactcctggtgaggggtgctcatgtagaagaaaggcttgtaaaaaatactgcaattgatcatgggaagcatgagagtgtaggaggcttacgtttcttcttggctctgtgtggcctgaacgcaagggacgctatgatggaagacgttggacagaatccactggatgatgtcctggaaagaaagctggccttgtcactagaagaagccaaagaggaggaggagttgaactatgtcatagatgaacaggaggaatccctgagggagctggaattagagacagcaaagctggagaaaagtaacgcaatcctaagcaggaatgtggtggaggttcagaaaaagatttcagggttatttacaaatattggccttgaagaagaaaccacaaagcagatcctggaggaaatgaaggcaagactacagaagtcaacagagtcctgtgcaaagcaagaggaggaactggccaaggcagaggcaatgtctcttccactgaggcttttcacacagtttggaaatttgaatgtcctcttttgtgacatgtctttcgcctgcatctgtgagatggagaggaccaccattaagaaacaggagagaaggtgttggtacaagtatttccagtatctcaccttcatggtcttagtctttattaggttgctggcttatgtgattttccacctgcagtacataaacccagatcttctcgtggatgtcctgcccctggtgctgagcaggggcaccttggagaacctggaggttggcttgtatgaagtggataaacagggccccctgctgtcagttgagtttatccatggtggagcacaaacaccagggatgcagcctggtggcttttgtgactcagcaaatgacccgtggacaaagcggcacaccaagcccgtcttgccagctagtgacaaagatcgccattttgatgccattaagtatttttcagggaatttgggggtgcttctgaggctgcggtttcaagaagtcagtagtgtgaaaactggatccctatatgacaattttcagcacttacgatcaagaacggctaggctgagggggcaggggggccaggccactggagcgaaacggcctctccggatctggaggcgtgggaacctcgggaatagtggggagttccagaccagttcccttcccccatctgaacaagtccagagcgtgcgccttgagaggcgctcggaaacagggaagctggggacacgtagcgagagactggttgtcgccctggctctcgtcaggccggcgcgtgctaggaaggcggggcctgtggcctgtggggcggagcctcggtggaggtcggcgcagctgcccctttgggctttggctctggactggagcgcagcatccttcgaggctgcagccgccacggctgttgccatgaggaaatcaaggatcatagagattaatgtgtttgcttacggggccggctctcaatggaatctggatagtagccaaaatcagtttcatttgctcgcaaccaagagaaacttaagaatggtcttcaaatttgcaaagaaagaaaaacatgatgaagaggaaactgaaacttaa

SEQ ID NO: 28019 - DNA, 2194 bp, Homo sapiens
atgggaaataagtatcttcaaagaactggagttaatttgaaagatgcatataaaggatccaatgccagaactccgctgatacttattcaaactcatgggatcgaccttaccaatatcctcctgagatttgcacaagagttaaaaggaacaacacatcatgtgaccataatttctctgggccgtgaccaagcagctaaagctgaagacctcattttaaaggcactaacaaaaacacaacaatgggtcttcctccagaactgccatcttgcaacatcatttatgccaaggctttgcacaattgtagaatcttttaatagtccaaacgtgacaatagaccctgagtttcggctatggttaagctcaaaatcatacagttcttttccaattcctgttcttaaaaagggtttaaagattgccgtggaatctccccagggattgaaaagtaacttacttcagacatttggatgtactgggagtggagaggtaacagaagagatatttgaaaatcctgactgtggacaatggtggaaaaaacttttatttagcctatgttttttcaatgctgtaatcaatgaaagaaaaaattacggaatattgggctggaatattgcttataaatttaattcttcagacttgggggttgccattaaggtgttggaaaattccctgagaggacagcccagcatttcgtggcaagcactgcgctacctgattggagaagtgatttacggtggccgggtgattgataattgggacaagcgatgcttgaagaccctactctacaaattttgtaatcctgaagtgctgaaagatgacttcagtttctccagtgatgggatatgtctgccagttccaggatctgcaagcataaaggactacatacacattatccagtccttacctgatgatgaccctcccgaggtcttaggaatacacccagaggccatcaggagctgctgggagacccagggtgaaaagtttattgaaaatctgattgccatgcaaccaaaaactaccactgccaacctcatgatcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatgtaactcttttcttaatatgagagtgcctacattgtggcagaaacacgcctacagatcttgtaagccactgagttcctggattgatgatctcatccagcgactgaatttcttcaatacttgggccaaagtggcttatactgcaatacagcgtcggtatatgagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataaatgtccatatcaaaccatt

SEQ ID NO: 28020 - DNA, 436 bp, Homo sapiens; identical to SEQ ID NO: 27996

SEQ ID NO: 28021 - DNA, 2088 bp, Homo sapiens
tcttgcagatttatcaggatgagcttccaggccccacgcagactcctggagctggcagggcagagcctgctgagggaccaggccttggccatctccgtcctggatgagctgcccagggagctcttcccccgactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggtggaaacttcaagtgctggaaatgcgggatgttgatgagaatttttggaccatatggtctggagccaggcccctgtcctgctccccagaggccatgagtaagagacagacagtggaggactgtccaaggacaggagagaagcagcccttgaaggtgttcatggatgtttgcctcaaggaaaaatccgtggatgaagatctgagcttcttctctgggtgggtgcagcacagaagacgttcagtacacctgtgctgtactaaggtggtaaattattcaatgaacattctaaatttcagaaacatattagaaacagtatacccagacagtatccaagtattggaaatttggaacatgtgctggccgtgtatggtagcagaggttagccgttacctgagccagatgaagaatcttcgaaaactcttcatctccgatggctgtggttacctgccaagctttgagagccaaggacagttagttgctgaattcagctctgtgttcctcaggctggagtacctccagatgctttatatgagaaggatccgcttcttcgaaggctacctggaccagctgatcaggtgcctcaagagcccgttggagacattggcattaacttatggctccctagatgaagaggacttgaaatgtctgccctggtacccaagtctcagtcaactgaagcagctgaatctgagtcatggtacactgcgcttcatccgtcttgagcccctccgagctctgctagagaaagttgctgccactcttcagaccctcttcttagtggactgtgggattggggactccaaactcagggtcatcctgcctgccctgagccgctgctccaacctcaccactttctgctttcacggcaatgacacgtccatggatggtctgaaggacctgctgcgccacacaggcaggctgagcaatttgagcctggaaacatatcctgcccctcgggagagtcttgacaacaggggtcgtgtcatttcggagctcctcaccccacttcaggctgagctgatgcgtatactgagggaagtaagggagcccaacaggatcttctttggtcccgtctcctgcccttgctgtggcatgtcacccactgagcaactggagttcaatttttgcttgcggggaaggcctgcctagtggggtggaggtataaaaagctttttctccaggcacttggaaactaaaatctaggacatagatatcttttatttttctttttccttattttacaattttacagcttttatttaaaaatttgagacagggtttccctatgttgtccaggctggtctcaaactcttacgcttaagggagccccctgcttggcctcccaagattctgggattacaggcataagcagctgtgccgggtctataggtgtattataaagggagcagagaaacctctgtttcaggcatgtgctttctgtgagtgggaaaaaaaacacaaaaaaacccagcagggggcagcactggggaaaaggttgaatggagtcactgagactcagggatctgtgtcctagacagtcagaaatagaacctgaagttctagagtgaaggagttatctcagcaaggatggatacaaagaaacgtcggaagtaaagggaacctaaatggaaactctctgctgtccttcatgattgattagcctgtttcagcaatttatacatcagaaatctttagttcctgatgaattaaaaaaagaggtactagttcatctgtgatttaagttcatccgcaggaaataaaggaatcaaaataaacttc

SEQ ID NO: 28022 - DNA, 1097 bp, Homo sapiens
atgagtgactactacatggttattagagtggcaaacaaaacagaaaaagaaacaactgctgcccctcctactaatactgagacagccaggtgggaaggggtccctggagaaactccaattagcctgcccactgaggtggagccttgggaagttcacaaggtttgcagcagagagaagcctgagcctggccccagtttttcatttgtagaacctgggattcaaactgtcaggtgggaagcgctccggcggaaggactctggccctgcaagactccaggtgacggctcctccttcactccagggcggagctctgcagaaaaggcggggaggcacggagggaggtgtactggggctgcgggattcgcggctacatgggcttctaggctctctcgcgcccaccctgccccgagctacggagccccttccggtcccgcggactccaagcctcaagtttccgccacaccctccagagaagcgtccccgccgcagccccggggggggcgggaggcgcgaggcgcggctgcgcccagcactggccccacctcccacgcgcccgcgggagatttgcttggggctggatcccccgcctaccgtttccccgcagccgccggcgcttctggcgcttgtgacccgagcaggaagcccagagagaaaccagaaagacaggaaggggattcctggacttcctttccacatccggcaggaacgcgaccctcctccagctaggagcgcttgtccgggcgcaccaagatgcctgcagcttcaagaagatgtatgggaacagacacagaaactttccctaccagataagcaggacaaagaaacacagactaagagttggcctgtgtggtcacggagtgggttaagagatgataaaaaaatctgctctgtacagatggcacacctggtcccaactaaaccctggggccctagaaagataagacatcccctcctcacaagcccctcctcaagagccccctcctcaagagcccatttataaaaactctgacattcttaactacaacttggcaatcttctcaggatccctctctaacagagacctgttctttccttttgcctattaaactcctgctccaa

SEQ ID NO: 28023 - DNA, 243 bp, Homo sapiens
atggagaatatcctctgttttctgaacagctatactgagacagggctgagccctgactcacattgtttggatattgacctcaacttcatctgcttgagtgggttggggttgtttatactgtacttgttctacatggtattgaccctgtattcatcacccaccgaaaaaaataatgacacccaaaagaccggaaaagtttgcagaaggaagcagaagaggaaagaaagctacattcttttctga

SEQ ID NO: 28024 - DNA, 374 bp, Homo sapiens; identical to SEQ ID NO: 27999

SEQ ID NO: 28025 - DNA, 1329 bp, Homo sapiens
tatccatgatatcaatccctctcaatcactaaatgactgtgacaacaccttgtccaattgttggtggcattaaaccagatggtatataagagtattttgtcaaaactgtaaaggaggatgtggctgtaggggctgatcattctcatgagtgttactgctctttttttcccacagttaaaagaatattggcagaggaagagccctggcattccagaaggagctaacaggaaaaagaaaatcaatggcagtagccctgacacagccacttctggtggttaccactcacctggggatgtgagtcttggcgggccaggctcctggggacagggggcccaaggggcatcagcagcaggtatctacagggagggccctgcatcatctgctaccctggaggatctggagagccagtaccaagaactagcagtagccctggattcaagctccgcaataatcagtcaactcagtgaaaacatcaattcactggttcagcagcccctctctccagggccctctcctccctgtgctttgggcacgttcgcacatcgaaggaggagaagaagcatgagatacatcgagtacagaagcttgggtttaccaaaaccagatggaggcccttattgtctgcttcctttctcagctgaacccctggccccagagcccccagcagggccctctgaggtggagcagctacaagatgagaccaaccacctaaggaaggagctggagagtgtgggaagacagctccaggctgaggtggaaaacaatcagatgttgagtctcctgaacaggagacagaaggagaggctacaggtgggtagccctgggctcctcccaggtctggacatcatcatcccagctagaggcatggagccccccaatcacagaggaagaggcagtggtataagaggctccttatgttgggaatctggaagccagccaccacatgccctcatgcccagggtcttccggcaggtgaagctgaagagccaagaggctccaagtctgcggcagcagcaagaccagtacctgtgtaccgctctaggagccctgatcccacaggagcttgggtgtgcggacaagcagtgtgatcttagtgaggtgagcctcactggtagcgtggaggctgcaccaggagaggacagggagggttctctccatgacaaccccactgcacagcagatccagcagctccttcctctaatgcaggactccccaggagcacccaggcttgggtggagaagctgttgtaaagatcagaagaaatcctttaagagtttaaatgtccctggaacaggcatacaggctctagtcaagaatgaatttgagtga

SEQ ID NO: 28026 - DNA, 1913 bp, Homo sapiens
gaaccccaggaaaggacggaacagaacaggacagggcccccagccccatctttatctcaccggctgctgctggctgccaagcctcccctgaatgggggagggtggtctgtgtgagtcagcggaggcacggagtggaggaagacgggagcctctgccgggcccgttgagcgtggcctcagaaatgcgccgctgggttagggtctccccgaccgaggctcgaatccaggtcgaagggtcgccggagcgatggttggagaatgtggaaggagctggaggacacccgagtattcttaaagcaatccccatggccaaaatcaacagctgatctggataccatcaagacacctgaaatcttatcatgagccagatgctgaggaagagactccgggaggatcccgaggacgccccagttgcagccatgttgagactgacgctgaggaggaccccaactgtcacgagcaacacctgtcgaacacagccacccacctggggacagatcaagaagctgtcacagatggcagaagaaaacctgaggaaagcgggacaaccagtcacaatgagtaatttcatggtagctatgatagcagttatcaccactgctgtgagtattccttcaacaagggctgacacagagaacaattatacttattgggcatatttatcaaccttggctggcaataatgcctagatgtaatcactctatgacacagttacacatgctttctgatctcagtatttaccataatctgctcctataattgaggcataccgcccttaaaaacctatttgtaaacaaaattgaacctggccagaaaaaatgaacgtacttgtttaggaagattgcattgcagaacaggcagaggtgctgcgcaacgattcctatggaatcactgttaattggtcccctaaggggatgtttagcttaaattgcacctctcagcctgcgtgccacggccacactatgtgcagctggtctgaacaaaacggtcagatggtagaaacaataagaagtatggcaaaagttcctattatctggaaccatgctggtatagtggcacctcaacctcaaacgataaggcccgctgtaggagctaaacattaaggatttgtagaaactattaatagctcttaataagatcaaaattggggaaagaataaagcatctagaaggacactctacaagctttttggatacagtaaaattaaaagaaaaaatatttaaagcatcccaggcacacctgaccttaataccagcaactggagtgcttaaaggaactgcagacagatttgcagctagtaacccattaaaatggataaaaatacttggaagctctgtaatttcaatgatgtgattgtgcttttaatctgtgttgtttgtctttgtgtagtctgcagatgtggatcctaactcctgcgagaagtaactcacagtgacaaagctgcctttgcttttatcgagttgcaaatcaaagaaggggggacatgttgggaacaggccccccaagatctggccataaactggccccaaaactggctataaacaaaatctgcagcactgtgacacgttcatgatggccgtgacgcccacgctggaaggttgtgggtttaccggaatgagggcaagggacacctggcccacccagggcggaaaaccgcttaaaggcgttcttaaaccacaaacaatagcctgagtgatctgtgccttaaagacacactcctgctgcagataactaaccagacccaccactttacttcggcccatcccttcatttcccataagggatacttttagttaatctattatctatagaaacaatgctaatgactgacttactattaataaatatgtgggtaaacctctgttggggctctcagctctgaaggctgtcagacccctgatttcccacttcgca

SEQ ID NO: 28027 - DNA, 2612 bp, Homo sapiens
ggggaggggccggccagccagggcaggcaggggcggcctctctgacgagaaggaggccactgggctgaggccaatgaatgggaaagagccagccatgtggtgagctgggagagggcatcccaggccgtgcgacctgcgcttgcaaaggccctggggccggacagttcttggcagagtctgagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtggcacccaggcgagtggtgcccaggtgagtgacagccaggtgaatggtgtccaggtgagtggcatcacccaggtgaatggtgtccaggtgagtggcatccaggtaagtggtgtccaggtggtggcacccaggtgagtggtgtccaggtgaggggcatcacccaggtgaatggtgtccaggtgagtggcatccaggtgggtggtaccgtcgacgtgacaatagctaacaattattgggctcattgtggacaggcactgtgccgagcttgacatcactgaactcagttcatcctcgccaggagcttgtgggccgtccctagatcagaatccgaggagaaaggacttccacacggcagccagcgagctggagggcggcctcctgccaccaccaggctccctaacccagtcctggatatctgtgaaagaatgagtggatccccacaggccagctatccccaaacacactcgtttacactgaagcaccaggagatcagaaccttctggaatcttaatatgcgaggactcggtggagaaggcggcactgaagaagagtcgtccctaggccaggctggagggaaactcaagacggcggcctggccctcctgggtggcggaagtgggagcagcaggagccctggcggatccgggaggccagaagagcggaagcttcctcccctctcaggacagccacaaggactttcgggggtcgtggcagctgctccacttccaacttccagatccctctcactttcctcttcccaccaactccaacctgggaccaagcaggggaaagcagctgcagcccagcttgacgcccctgcaaatggagacctgtgcacctggttgtgagcattttaaagggtgtcacacagggcatacccttcggtgcctggattcctttgatgaaaaggcaaagccttgaacctaagtcatcttcgagtcctcagcacttcacccagagcctggcacacagtaggagcacagaaaggtttacatccagcaggagttggccctgagctctgagtccagatcattgctcttggctgaagcagcctgtctactcacaaagatgagcatggtccctgccacgaggaaactcgtggtcctgtggactgcggtgtggagggaaagcttgggattctgagcctgataatgcaccattacatccccactcactcgggctgtgtgaacccagcaagtcacaggatcactgggtggtgaaagaaagaaacactcacagaagcgtctgtgcttggagagccatctggtccatcattgtgactgctgctctcattgctatcatgggtgtcaccattgccatcactcaaggacttctctccaggccccgaagccaagctggtgcctggttcctctgggttgggagaggggctgggcatggacaggaggagggaaaagggacctgtgctagcaggtgatgccatccaagacatctgcatcctaatccctggaacctgggattccactaggtgccatggcaaagagggattaaggtggcaggtggagtgaaggttgctaatcagccgaccttaaagtagggagatgatcctgaatgagacaaaagagagaaccagtcatggtgtcatgagaaggactcaaaatgcaactgctgactttgaagattaaggggctacaaaccaaggaacgtggtagtctctggaaaagacaaggaatagacgctgccttggggccaccagaaggaaccagccctgtcaacaccctaattttagcccagtgaggcctgtgctggacttctgacctccagaactgtaaactaataaatgtgtgttgtttctgcc

SEQ ID NO: 28028 - DNA, 2666 bp, Homo sapiens
gcctctctgacgagaaggaggccactgggctgaggccaatgaatgggaaagagccagccatgtggtgagctgggagagggcatcccaggccgtgcgacctgcgcttgcaaaggccctggggccggacagttcttggcagagtctgagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtggcacccaggcgagtggtgcccaggtgagtgacagccaggtgaatggtgtccaggtgagtggcatcacccaggtgaatggtgtccaggtgagtggcatccaggtaagtggtgtccaggtggtggcacccaggtgagtggtgtccaggtgaggggcatcacccaggtgaatggtgtccaggtgagtggcatccaggtgggtggtaccgtcgacgtgacaatagctaacaattattgggctcattgtggacaggcactgtgccgagcttgacatcactgaactcagttcatcctcgccaggagcttgtgggccgtccctagatcagaatccgaggagaaaggacttccacacggcagccagcgagctggagggcggcctcctgccaccaccaggctccctaacccagtcctggatatctgtgaaagaatgagtggatccccacaggccaggtgggcggggacggagggctattgtttcctgggacaaacgtgtgtggggagctgagtgtttctcctttctcagccctgacttcccacagctatccccaaacacactcgtttacactgaagcaccaggagatcagaaccttctggaatcttaatatgcgaggactcggtggagaaggcggcactgaagaagagtcgtccctaggccaggctggagggaaactcaagacggcggcctggccctcctgggtggcggaagtgggagcagcaggagccctggcggatccgggaggccagaagagcggaagcttcctcccctctcaggacagccacaaggactttcgggggtcgtggcagctgctccacttccaacttccagatccctctcactttcctcttcccaccaactccaacctgggaccaagcaggggaaagcagctgcagcccagcttgacgcccctgcaaatggagacctgtgcacctggttgtgagcattttaaagggtgtcacacagggcatacccttcggtgcctggattcctttgatgaaaaggcaaagccttgaacctaagtcatcttcgagtcctcagcacttcacccagagcctggcacacagtaggagcacagaaaggtttacatccagcaggagttggccctgagctctgagtccagatcattgctcttggctgaagcagcctgtctactcacaaagatgagcatggtccctgccacgaggaaactcgtggtcctgtggactgcggtgtggagggaaagcttgggattctgagcctgataatgcaccattacatccccactcactcgggctgtgtgaacccagcaagtcacaggatcactgggtggtgaaagaaagaaacactcacagaagcgtctgtgcttggagagccatctggtccatcattgtgactgctgctctcattgctatcatgggtgtcaccattgccatcactcaaggacttctctccaggccccgaagccaagctggtgcctggttcctctgggttgggagaggggctgggcatggacaggaggagggaaaagggacctgtgctagcaggtgatgccatccaagacatctgcatcctaatccctggaacctgggattccactaggtgccatggcaaagagggattaaggtggcaggtggagtgaaggttgctaatcagccgaccttaaagtagggagatgatcctgaatgagacaaaagagagaaccagtcatggtgtcatgagaaggactcaaaatgcaactgctgactttgaagattaaggggctacaaaccaaggaacgtggtagtctctggaaaagacaaggaatagacgctgccttggggccaccagaaggaaccagccctgtcaacaccctaattttagcccagtgaggcctgtgctggacttctgacctccagaactgtaaactaataaatgtgtgttgtttctgcc

SEQ ID NO: 28029 - DNA, 1940 bp, Homo sapiens
atggctgtcttcattggcaagtgtcctgccaagggcacccgacgtccttgcctgcacaagtccacgtttgctgtggaacgttgtggcttctgtggctcctcaggcccgggggcgccccttgaaccctccactcttggctccaagcaccttccctgggaagctgtatctgctgggttcgcagacaggaacagaaacatggatggagccatgtggctgagcctctgtcctgataacgaagacctgctttggaggaaaaagcacaaattgctacaagcccggggcaaaggcgatctcgctctgcagagaagagcggatgccaagctgtggaaaaactaccagctccagcgcttggctgaggagttgaggagagggtatcaggaggcacagcacctgcacgtcggtggcctggacaggctgcagtcagcacgtctgttgggctggggaggaggacgggccagggaaaatgagcctgactcgcaggggcccatccagcgaagatcagccaggcccccgagggccaaggagaagcatagagcagcccttagtgaagagaggagttgcagggaagagttgggccagcaacaccccaggcactccaggccccggaagacagcagcgagtccagagaaaccacagactacaaaagccacgggtcggatgaattctcacctggccccgcctgagaagagaaagggaaggccagaaccttcgaccaagtctgggggtggccgctgtgccatccatcctcggaggagcaaaggggcggacctagaaaggtcaaacccactcgtggctgctgtgggagaaatcgggcttgtggaggaaaaagagaaaggaacagctcgggcggggaggaggcaactgggaaagggggcagtttgctttgttccagccctgaccagtcgctctcagggacagagtctggaggggaagctgagagacctcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgtccaagaccgacttgaaaacgttcatgggcaaggcccagaaccaaaaatatcagggcacggtcaagcccacgtttagaaatggaagtcaaacattgtctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaaatgcgagaggcccacccggggtaaatacatcactgataatggtgctgccagca

SEQ ID NO: 28030 - DNA, 780 bp, Homo sapiens
atgtgcctgtattgctgggacatcgagccttcccaagtcaaccctgaaggaccaagacaacatcatccttcagaggtcactgagcagcagcttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccattttggaaaaataaacacagtgcaagtatttaatatccaagctacaggctctagaattttattaaatgccatctctcactaccatatttttctttcctgtggtaaacttgaaatttgctgcttttcaacaaataataatgaatatgtataggtagacttttgaaaaatattattctcatttaaatttttgcaaatgttttatgacatatttagatgtttagaagtatgttataataatagaacaccagatttcctctgctgtatatttataatgacttccatttaaacaaaatgtttaaatactttaaacagtcctaggagactgttattataactaactcctgtattttgtgttgctattgcagataagccatagtgtaattaaaatttccatttaaggtaaaatttgaatattgaattaaaattttacttttaggtatgaaataaattataattat

SEQ ID NO: 28031 - DNA, 651 bp, Homo sapiens
atggcttctatgggcactacagaagccaattcaagaaccagttcttgcctctcccagaacccaaaagcatcatcccagcccttccatggctgtactgacacctatccctgggacaggctttacctttcttctctgagatgtcagatctttcccctacagacagggtggaaaagagagccagcgcagcgacacttcttctccaagcacgacaaccgtacttcctttgacaaagagggtccctattgcctgctgcagggaatcggaaggcggaaggacctggagcgcctgtggcagcggcacaccttcctgcgctgggcaccctgtgagatagagttgcgccagcaggggcccctggaatcttcttaccaggctgatttcaggccaggcccaggactcagtggcctcccccagcacctcatccactttgtgcaggtccagccttcccataccaggaccacctaccagcagaacttctgctgcccatcccagggtggccactatggcagctacaaggtagggccccaggcgccggtcactgacgtactgcctgacctcccagggatcccaagacccaagctgctgcagcactaccttcatgctggggtctctgagtgtctaaactggtccagagcattaaacaaggacagctga

SEQ ID NO: 28032 - DNA, 440 bp, Homo sapiens
atggacacgcaaaatttagagaagacagccataaagattcagtcatggtggcgtggaaacatggtgcgccagacgttactgcaggcagcactcagagcctgggtcatccagtgctggtggaggtcaatgcaggccaagatgttggagcaaagacggcgcctggcactaagactctatacctgccaggagtgggcggtggtgaaggtgcaggcacaggttcgaatgtggcaggcccgcaggcggttcctccaggcacgccaagcggcctgcatcatccagtctcactggcgctggcatgccagccaaacccgaggcctgatccggggccactatgaggtcagagccagccggctggagcttgacatcgaaatcctcatgacctagggcgctgacagagccaaggaggctggatctctcttccaataaagacccttactgac

SEQ ID NO: 28033 - DNA, 485 bp, Homo sapiens; identical to SEQ ID NO: 27990

SEQ ID NO: 28034 - DNA, 7380 bp, Homo sapiens
tgcatgctggatgcagtggctcatgcctgtaatctcagcactttgggaggccaaggtgggaggatcgcttaaactcaggagtttgagaccagcctgggcaacatggtgaaaacctgtctctataaaaaattaaaaaataataataataactggtgtggtgttgtgcacctagagttccaactactagggaagctgagatgagaggataccttgagctggggactggggaggcttaggttacagtaagctgagattgtgccactgcactccagcttggacaaaagagcctgatcctgtctcaaaaaaaagaaagatacccagggcaagttaagttcggaggggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggtttcatggtaatcagccctcctcttgaagaaatttaggagcttgcagtcacccagtcatctcaacaacatccccaaatgcattcttaccatgctggagatcccaaagttcttagaggctcttgtgttagaaacctgggaccaagaccaaatattaaaacaaaagatgctcctgtcacatctatcactgaggtctttgtaagagctttagaagctctgtgccaggaaccagggacagagattaaatatatatttcttttcttttttttgagacagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccaaatggggtcttcttttgttgcccaggctggccacaagttcctgggctcaagtgatcctcccacctcgtccttgtagagatgagatttagttatgtcgtccaggctgatctcaaactcctgggctaaatcgattgactcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagtggtgtcgagtgagggagtgagggaagcttcctctgtatttacagccactcccctttgctcacattcccgcctgagctccaccttctcagatgagcagcagcattagatgctcataggagaacgcaccctgttgtgaaccatgcatgtgagggatctaggttgcgctgtccttatgagagtctaatacctattgatctgtcactttctcccatcacgctcaggtgggaacatccagttgcaggaaaacaagcttaacacgcccactgattctacattatgctcctacctcccggcagcctctccaggcccagaactttctccagtcagcctctacagaccaagctcatgactcaaaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacgtcaacctcccacgtggctgagactacaggtgcttgccactatgcccaactaatatttggaattttcatatacgtggattccagaggggtgacagcgaaacgtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggtggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcccgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccatgaggtgcccagaagatcatgcagtcatcagtcccacggagcagcctgcgaggctgaggctcctcccactggacagccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaatgtacgtataaaatatgattttctaaccacttgctcgccaacaaggaaaacttttaagtagagcagaacctgaatagacaagacatttctttcttttggtagaaaatgatttaccatcactgtgtagttaattgtagactaggtaattttaactttgtgatttattgccggagacattttcttctgtactgtaaagtg

SEQ ID NO: 28035 - DNA, 7282 bp, Homo sapiens
tgcatgctggatgcagtggctcatgcctgtaatctcagcactttgggaggccaaggtgggaggatcgcttaaactcaggagtttgagaccagcctgggcaacatggtgaaaacctgtctctataaaaaattaaaaaataataataataactggtgtggtgttgtgcacctagagttccaactactagggaagctgagatgagaggataccttgagctggggactggggaggcttaggttacagtaagctgagattgtgccactgcactccagcttggacaaaagagcctgatcctgtctcaaaaaaaagaaagatacccagggcaagttaagttcggaggggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggtttcatggtaatcagccctcctcttgaagaaatttaggagcttgcagtcacccagtcatctcaacaacatccccaaatgcattcttaccatgctggagatcccaaagttcttagaggctcttgtgttagaaacctgggaccaagaccaaatattaaaacaaaagatgctcctgtcacatctatcactgaggtctttgtaagagctttagaagctctgtgccaggaaccagggacagagattaaatatatatttcttttcttttttttgagacagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccaaatggggtcttcttttgttgcccaggctggccacaagttcctgggctcaagtgatcctcccacctcgtccttgtagagatgagatttagttatgtcgtccaggctgatctcaaactcctgggctaaatcgattgactcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagtggtgtcgagtgagggagtgagggaagcttcctctgtatttacagccactcccctttgctcacattcccgcctgagctccaccttctcagatgagcagcagcattagatgctcataggagaacgcaccctgttgtgaaccatgcatgtgagggatctaggttgcgctgtccttatgagagtctaatacctattgatctgtcactttctcccatcacgctcaggtgggaacatccagttgcaggaaaacaagcttaacacgcccactgattctacattatgctcctacctcccggcagcctctccaggcccagaactttctccagtcagcctctacagaccaagctcatgactcaaaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacgtcaacctcccacgtggctgagactacaggtgcttgccactatgcccaactaatatttggaattttcatatacgtggattccagaggggtgacagcgaaacgtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggtggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcccgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccatgaggtgcccagaagatcatgcagtcatcagtcccacggagcagcctgcgaggctgaggctcctcccactggacagccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccag

SEQ ID NO: 28036 - DNA, 538 bp, Homo sapiens
tttaggtgctgtctctcctgttgttgttgtcctttacacgatggtgttgcaagaaaatggatatggtgttgaggaagacattccaacattactaatggctgctagcagtatggatgacattctggctatcactggattcaatacatgcttgagcatagtcttctcctcgggctgtgctaggtcctctggctctagaaacagcaagagtctccgcaccccacttggaaccatatgcgaaggatgtgatgacagtagcatttttagccatctcgatcacagctccaaatggagctctacttatgggcattctggggcctaaaatgcttacacaccattatgatccaagcaaaataaaactgcaattgtcaacattagaacatcattaaaaagtttacctgtcatcatctgcctgcttcttttaatgaattatttcacatgactgaagaattttaaagtagaaatatgtaggaactgcacagaaaatccaggatttagtaaacatgtgatttcagtacagggcttttcttggactttttac

SEQ ID NO: 28037 - DNA, 3311 bp, Homo sapiens
tgattattaagacccattgacatgagattacatcctctgcctataaaaatcctggaagaaaacctaggaaatattcatctggacattgcacttggcaatgaatttatggatagaaaatgcagttgaaagatatttcataaaggaagaaaagaagtatgaatacagctttaaccatttattttggtggagtctttaagattttctctatcttgagtgcgcgaggcgcggggagcctaggacctggagcgagagccgcctacctgcagccgccgcccacggcacggcagccatcatggcgttcctgctgcgcttcgtgctcctgtgcggagtcgcggatttcaccagaagtttgagtatcactactcctgagcagatgattgaaaaagccaaaggggaaactacctatctgccatgcaaattatgcttagtcctgaagaccagggaccactggacattgagtggctgatatcaccagctgataatcagaagatggatcaagtgatgattttatattctggaaacaaaatttatgatgattactatccagaactgaaaggccgagtacattttaagagaaatgatctcaaatctggtgatgcttcaataaatgtaacgaatttacagctgtcagatattggcacagatcagtgcaaagtgaaaaaagctcctggtgttgcaaataagattcagctggtagttcttgttaagccttcaggtacaagatgttatgttgatggatcagaagaaattggaagtgactttaaactaaaatgtgaaccaaaagaaggttcacttccattacagtatgagtggcaaaaattgtctgactcacagaaaatgcccacttcatggttagcagaaatgacttcatctgttatatctgtaaaaaaaatgcttcttctgagtactctgggacatacagctgtacatcagaaacggagtgggctctgatcagtgcctgttgcgtgtaaacgttgtccctccttcaaataaagctggactaattgcaggagccattataggaactttgcttgctctagtgctcattggtcttatcatcttttgctgtcgtaaaaagcgcagagaagaaaaatacgaaaagtaagttcatcacgatatcagggaagatgtgccgcctccaaagagccgtacatccgctgccagaagctgcataggcagtaatcattcatccctgggatccatgtctccttccaacatggaaggatattccaagactcagtataaacaagtaccgagggaagactttgaacgcactcctcagagtccgactctcccacctgctaaggtagctgcccctaatctaagtcgaatgggcgtgattcctgtgatgattcccgcacagagcaaggatgggtctatagtatagagcctccatacgtctcatctgtgctctccgtgttcctttccttttttgatatatgaaaacctattctggtctaaattttgttactagcctcaaaatgtatccaaaaataagttaatcaggagctgtaaggaatatatttttttaaatttttctttggttatatcgaaatagttacaggcattaaagttagtaaagacaagtttaccatctgaaaaagctggattttctttaagaggttgattataaaggtttctaaatttatcagtacctaagtaagatgtagcactttgaatatgaaatcataagtgaagacattggtgaacttacttgcataccaagttgatacttgagtaaccatctgaaagtggtacttgataatttttaccgttatttttaggatgtgtatctcatttatttatggcccactagtctcccccaaattagtacagaaacatccatgacaaaattacacatgtgtgtttgtacttgttttcacagctccttggaaaactctgtgttaggaatatctctaaaaacatagaaaactctacagtggtttagaaattactaattttacttctaagtcattcataaaccttgtctatgaaatgatttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtggtctcatgccttgagatctgtggtggtctttaaaatggtggccagccagatcaaggatgtagtatctcatagttctggactaaatactggctttccactttaggtgatatttttcttattagaaaaatattataactcatttattgtttgacagttatagattgaaatttcctaattctaaattttaagtggttcttcagtttcagtgctttatgttgtttgttgttggtttggcatggcattacatattatatgttctagaaacatgtaatcctaaatttaccctcttgaatatgatccctagatgatatttttatcataaatgcagaataatcaaatatattttaagcaagtaagtgtcctccatcaattctgtattccagacgtgggaggatgtacagttgctgttgtgtgatcaagcatgtctctgtgtagttccagcaaatcaagctgagctttgaaaaagtttgagtcttagttttgtgaaagtggtttattctcaaaaaaaaaaaaaaagaaaaagaaaaagaaaaaagataagaagaaggagtaaagggactactcctccttgccaaatgtgctaaatatcattttaggagaagaaagtggatttattgtatttcccttaagattgtgagggagtgtggatacagtagaacgagccaacagtttctttataataaatacggtctgcaataaattatttcactagctgtaaaacctttccctagattttagtagggagttggtttctgttaatatctttggtgctgtggtggtaaatgctacattataaacagtggcatgtatttacagttagagtattgtgtgtacactttttaatggtaaacttaagctgaatgtgtaatggatttgtctatagttttacatatttggaagcattttaaaataggttttaatcttacataaaattacttttatacttgtgttaacattttcttctgtgccttttgggtaatttaatttctgttatgaatttctggtgcctatgagctagctatcacctacctgaaaggtgcttagaggtgaaggtactgtttctaaaaacacatcactgtgacacctttctatcctcacattttcaagcttgcctcttttctgttctttgtggatataacgtaagtgat

SEQ ID NO: 28038 - DNA, 1854 bp, Homo sapiens
ggatctcctgccgttggtcctaagtgccactgtgtgtgctgagtttttcaaaggtcagagcagattgaacctttgtggtttcattttccctgattttgatttttcttatggggaacctgtcttgctgcattcaaggtgactcgaagaagccttcccaaaggcgtgtgaaaaggcagccctactctactaccaaggtgacgtcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgcgagggtggtgcaggtggcccctctgaggcttgaatctagagccattgacactggagaatgatacgtaccctgaaataactcacttcctgaggaaaaagcgccatctctagggtacagaaacctgattctgggctccttttgcgaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactgctttccacgtaagatccaattggagagagttcccaggggccttcgggttatccatgctgcttgggaggttaagggagggggcatgaaatcaaaacgaaacaggaaatatgtgtcatattggatttggtcttttccgggtttattggcataatagttagaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagagacacaactctctcacaggcacttcctccaacctggagacagaattctcctggtgtgtgcccaggggtggaggagaaattgacagtttgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccctggaacactcatctatacctgtctgacaaggtcaagctccaaggaagggactctctacatatctacattgtttgcagattttacaataatcatttattcttgcatggctgatcattgttaaccaatacaaataaaataataaagaaatga

SEQ ID NO: 28039 - DNA, 530 bp, Homo sapiens
ctgagtttttcaaaggtcagagcagattgaacctttgtggtttcattttccctgattttgatttttcttatggggaacctgtcttgctgcattcaaggtgactcgaagaagccttcccaaaggcgtgtgaaaaggcagccctactctactaccaaggtgacgtcagggagcacattcaatggtacgtattctggaatcactcactggttgttagaaaaggattctataggaaatctggagcttaactgctggcttttgtctggagagcctccatgatccaagacatctggtgggaatgaggatgtggggtatagtaaaagaaactggttttccaggtgacatactctttttatctatgtatagtttctgggaatgtgttcacattaggttgtgtgtgggtatgtgtgtattagggcgggggtggggtgaggtggtctgtgtgcaagtctgcatgatttgcttgtgaatgtgtgtctatgtgtgtttcccccaggaaaaaaatgttgtgtttacccagcacaactgtcagt

SEQ ID NO: 28040 - DNA, 314 bp, Homo sapiens
gagcagattgaacctttgtggtttcatattccctgattttgaattttcttatggggaacctgtcttgctgcattcaaggtgactcgaagaagccttcccaaaggcgtgtgaaaaggcagccctactctactaccaaggtgacgtcagggagcacattcaatggtacgtattctggaatcactcactggttgttagaaaaggattctataggaaatctggagcttaactgctggcttttgtctggagagcctccatgatccaagacatctggtgggaatgaggatgtggggtatagtaaaagaaactggttttcc

SEQ ID NO: 28041 - DNA, 3207 bp, Homo sapiens
tggacctcacagtgtggattgtgccttcaccctggaatgtttatgccctatcgccatggtgatgggattagggatctcctgccgttggtcctaaatgccactgtctgtgctgagtttttgaaaggtcagagcagattgaacctttgtggtttcattttccctgattttgatttttcttatggggaacctgtcttgctgcattcaaggtgactcgaagaagccttcccaaaggcgtgtgaaaaggcagccctactctactaccaaggtgacgtcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgcgagggtggtgcaggtggcccctctgaggcttgaatctactccccatgaggacaccgtacacgacatcactaacgaggacgccacacacgacatcgctaacgaggatactgtacacgacatcgctaacgaggccgccgacaagggcatcgccaacgaggacgccgcccagggcatcgccagcgaggacgccgcccagggcatcgccagggaggacgccgcccagggcatcgccaaggaggacgccgcccagggcatcgccaaggagggcgccgcccagggcatcgccaaggaggacgccgcccacggcatcgccaacgaggactccgcccacggaatcgccagcgaggacgccgcccacggcatcgccagcgaggacgccgtccagggcatcgccaaggaggacgccgcccagggcatcgccaacgaggacgccgcccagggcatcgccaaggaggacgccgcccagggcatcgccaaggaggacgccgcccagggcatcgccaacgagggcgccgcccagggcatcgccaaagaggacgccgcccagggcatcgccaacgaggacgccgcccagggcatcgccaacgaggacgccgcccacggaatcgccagcgaggacgccgcccacggcatcgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggtggggggggagggatagcatcgggagatatacctaatgctagatgatgagttagtgggtgcagcgcaccagcgtggcacatgtatacatatgtaactaacctgcacaatgtgcacatgtaccctaaaacttaaagtatatatatataaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacaaggcacgctaacgaggatgctgtacacgacatcactaatgaggacagtgtacaagccatcactaatgaggacactgtatatggcatcgctaacgaggacactgtacaaggcattgctaacgaggacgctgtacacaacatcgctaatgaggacaccatataagacatcaccaatgaggatgctgtatatgacatcgctaatggcatccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagctaatgaggttgctgtatatgacatcgctaatgaggacattgtatatgacatcgctaatgaggacgctctatacgacatcattaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgagccattgacactggagaatgatacgtaccctgaaataactcacttcctgaggaaaaagcgccatctctaggatttgattgtggagagcatatctgatgatggggatttgtaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccctggaacactcatctatacctgtctgacaaggtcaagctccaaggaagggactctctacatatctacattgtttgcagattttacaataatcatttattcttgcatggctgatcattgttaaccaatacaaataaaataataaagaaatgacccac

SEQ ID NO: 28042 - DNA, 4424 bp, Homo sapiens
cttgtatatgtgggttaaagaccctcagcctcaagccaagcctcctccatgaggagccatctcactattgaccggctagtgccgggtatggccaccagcccaactgaaacaaaatgttgctctaaaacaagtgtaaatctcatacatacaacaggcaaatgcagaagcagtgtggtctcgcaagttgtaaagaggacagtcgcaattttgctggacttcaacctgggtagaagacatgagggaactctgtcactaaatcacggcagagttcaaggccacttgtagactatttcatgttacagaaggtggcctttagctactaagcaaaggcctctgtttctcatttctttcctgttcatcttcttggtcatccttcttccgcaagggaaacgagcccaagcaaaaggcagtttcaatattaatttgactgaggttttgtgcagtttattatcatccaggtaatcaggtgcaacccagtctgcctagcagcccccctatctctgctctgtgttttcatttaataaacattttggtctacttactatgtgctagattttctcgagaccaagtaaatgagatagaatctttatgttggcagctaagttagatttcacataactgacaaaaattaaaatttctgatttcttgtaaaaatattttgtatgtgtgaatgcatactgaacgtaaagtggataaaaaactcacacttgcactcatgggaggcttttcatgaatttgtcaatttttattttttatatttccccacttcaccagataatgcatacctgaacctggaaactgattcccactgcagaaagtgttctgagccacatcccttagcttcactagtgcaggtccacctgggaggatgtcccagcatcagcttgacccatgctgtgatcagccacctccatgcatcacaccaagcaagcccctgggtgattcacagtctccaccaccagggcactgaccttaactctgtgtttttctagctccccatgaggacaccgtacacgacatcactaacgaggacgccacacacgacatcgctaacgaggatactgtacacgacatcgctaacgaggccgccgacaagggcatcgccaacgaggacgccgcccacggcatcgccagcgaggacgccgcccacggaatcgccagcgaggacgccgcccacggcatcgccagcgaggacgccgcccagggcatcgccagcgaggacgccgcccagggcatcgccagggaggacgccgcccagggcatcgccaaggaggacgccgcccagggcatcgccaaggagggcgccgcccagggcatcgccaaggaggacgccgcccacggcatcgccaacgaggactccgcccacggaatcgccagcgaggacgccgcccacggcatcgccagcgaggacgccgtccagggcatcgccaaggaggacgccgcccagggcatcgccaacgaggacgccgcccagggcatcgccaaggaggacgccgcccagggcatcgccaaggaggacgccgcccagggcatcgccaacgagggcgccgcccagggcatcgccaaagaggacgccgcccagggcatcgccaacgaggacgccgcccagggcatcgccaacgaggacgccgcccacggaatcgccagcgaggacgccgcccacggcatcgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggtggggggggagggatagcatcgggagatatacctaatgctagatgatgagttagtgggtgcagcgcaccagcgtggcacatgtatacatatgtaactaacctgcacaatgtgcacatgtaccctaaaacttaaagtatatatatataaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacaaggcacgctaacgaggatgctgtacacgacatcactaatgaggacagtgtacaagccatcactaatgaggacactgtatatggcatcgctaacgaggacactgtacaaggcattgctaacgaggacgctgtacacaacatcgctaatgaggacaccatataagacatcaccaatgaggatgctgtatatgacatcgctaatggcatccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagctaatgaggttgctgtatatgacatcgctaatgaggacattgtatatgacatcgctaatgaggacgctctatacgacatcattaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgagccattgacactggagaatgatacgtaccctgaaataactcacttcctgaggaaaaagcgccatctctagggtacagaaacctgattctgggctccttttgcgaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactgctttccacgtaagatccaattggagagagttcccaggggccttcgggttatccatgctgcttgggaggttaagggagggggcatgaaatcaaaacgaaacaggaaatatgtgtcatattggatttggtcttttccgggtttattggcataatagttagaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagagacacaactctctcacaggcacttcctccaacctggagacagaattctcctggtgtgtgcccaggggtggaggagaaattgacagtttgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccctggaacactcatctatacctgtctgacaaggtcaagctccaaggaagggactctctacatatctacattgtttgcagattttacaataatcatttattcttgcatggctgatcattgttaaccaatacaaataaaataataaagaaatga

SEQ ID NO: 28043 - DNA, 1854 bp, Homo sapiens
ggatctcctgcccttggtcctaagtgccactatctgtgctgagtttttcaaaggtcagagcagattgaaccattgtggtttcattttccctgattttgatttttcttatggggaacctgtcttgctgcattcaaggtgactcgaagaagccttccaaaaagcgtgtgaaaaggaagccctactctactaccaaggtgacttcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgtgagggtggtgcaggtggcccctctgaggcatgaatctagagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccagatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctctacatatctacattgtttgcagattttacaataatcatttattcttgcatggctgatcattgttaaccaatacaaataaaataataaagaaatga

SEQ ID NO: 28044 - DNA, 347 bp, Homo sapiens
tgccactatctgtgctgagtttttcaaaggtcagagcagattgaaccattgtggtttcattttccctgattttgatttttcttatggggaacctgtcttgctgcattcaaggtgactcgaagaagccttccaaaaagcgtgtgaaaaggaagccctactctactaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcc

SEQ ID NO: 28045 - DNA, 530 bp, Homo sapiens
gctgagtttttcaaaggtcagagcagattgaacctttgtggttccattttccctgattttgatttttcttatggggaacctgtgtggctgcattcaaggtgactcgaagaagccttccaaaaagcgtgtgaaaaggaagccctactctactaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctacgaaaaaaatgttgtgtttacccagcacaactctcag

SEQ ID NO: 28046 - DNA, 347 bp, Homo sapiens
tgccactatctgtgctgagtttttcaaaggtcagagcagattgaaccattgtggtttcattttccctgattttgatttttcttatggggaacctgtgtggctgcattcaaggtgactcgaagaagccttccaaaaagcgtgtgaaaaggaagccctactctaccaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcc

SEQ ID NO: 28047 - DNA, 530 bp, Homo sapiens
gctgagtttttcaaaggtcagagcagattgaacctttgtggtttcattttccctgattttgatttttcttatggggaacctgtgtggctgcattcaaggtgactcgaagaagccttccaaaaagcgtgtgaaaaggaagccctactctaccaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcag

SEQ ID NO: 28048 - DNA, 1854 bp, Homo sapiens
ggatctcctgcccttggtcctaagtgccactatctgtgctgagtttttcaaaggtcagagcagattgaaccattgtggtttcattttccctgattttgatttttcttatggggaacctgtgtggctgcattcaaggtgactcgaagaagccttccaaaaagcatgtgaaaaggaagccctactctactaccaaggtgacttcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgcgagggtggtgcaggtggcccctctgaggcttgaatctagagccattgacactggagaatgatacgtaccctgaaataactcacttcctgaggaaaaagcgccatctctagggtacagaaacctgattctgggctccttttgggaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactgctttccacgtaagatccaattggagagagttcccaggggccttcggggtatccatgctgcttgggaggttaagggagggggcatgaaatcaaaacgaaacaggaaatatgtgtcatattggatttggtcttttccgggtttattggcataatagttggaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttcctccaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggccaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatga

SEQ ID NO: 28049 - DNA, 3208 bp, Homo sapiens
tggacctcacagtgtggattgtgccttcaccctggaatgtttatgccctatcaccatggtgatgggattagggatctcctgcccttggtcctaagtgccactatctgtgctgagtttttcaaaggtcagagcagattgaaccattgtggtttcattttccctgattttgatttttcttatggggaacctgtgtggctgcattcaaggtgactcgaagaagccttccaaaaagcatgtgaaaaggaagccctactctactaccaaggtgacttcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgcgagggtggtgcaggtggcccctctgaggcttgaatctactccccatgaggacaccgtacacgacatcactaacgaggacgccacacacgacatcgctaacgaggatactgtacacgacatcgctaacgaggccgccgacaagggcatcgccaacgaggacgccgcccacggcatcgccaacgaggacgccgcccacggcatcgccagcgaggacgccgcccacggaatcgccagcgaggacgccgcccacggcatcgccagcgaggacgccgcccagggcatcgccaacgaggacgccgcccagggcatcgccaaggaggacgccgtccacggcatcgccaacgaggacgccgcccagggcatcgccaacgaggacgccgcccagggcatcgccaaggaggacgccgcccagggcatcgccaacgaggacgccgcccagggcatcgccaaagaggacgccgcccagggcatcgccaaggaggacgccgcccagggcatcgccaacgagggcgccgcccagggcatcgccaaagaggacgccgcccatggcatcgccaacgaggacgccgcccagggcatcgccaacgaggacgccgcccacggaatcgccagcgaggacgccgcccacggcatcgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggttggggggggagggatagcatcgggagatatacctaatgctagatgatgagttagtgggtgcagcgcaccagcacggcacatgtatacatatgtaactaacctgcacaatgtgcacatgtaccctaaaacttaaagtatatatatataaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacaaggcacgctaacgaggatgctgtacacgacatcactaatgaggacagtgtacaagccatcactaatgaggacactgtatatggcatcgctaacgaggacactgtacaaggcattgctaacgaggacgctgtacacaacatcgctaatgaggacaccatataagacatcaccaatgaggatgctgtatatgacatcgctaatggcacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgagccattgacactggagaatgatacgtaccctgaaataactcacttcctgaggaaaaagcgccatctctaggatttgattgtggagagcatatctgatgatggggatttgtaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggccaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatgacccac

SEQ ID NO: 28050 - DNA, 347 bp, Homo sapiens
tgccactatctgtgctgagtttttcaaaggtcagagcagattgaaccattgtggtttcattttccctgattttgatttttcttatggggaacctgtgtggctgcattcaaggtgactcgaagaagccttccaaaaagcatgtgaaaaggaagccctactctactaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcc

SEQ ID NO: 28051 - DNA, 531 bp, Homo sapiens
gctgagtttttcaaaggtcagagcagattgaacctttgtggtttcattttccctgattttgatttttcttatggggaacctgtgtggctgcattcaaggtgactcgaagaagccttccaaaaagcatgtgaaaaggaagccctactctactaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcagt

SEQ ID NO: 28052 - DNA, 4344 bp, Homo sapiens
cttgtatatgtgggttaaagaccctcagcctcaagccaagcctcctccatgaggagccatctcactattgaccggctagtgccgggtatggccaccagcccaactgaaacaaaatgttgctttaaaacacgtgtaaatctcatacatacaacaggcaaatgcagaagcagtgtggtctcgcaagttgtaaagaggacagtcgcaattttgctggacttcaacctgggtagaagacatgagggaactctgtcactaaatcacggcagagttcaaggccacttgtagactatttcatgttacagaaggtggcctttagctactaagcaaaggcctctgtttctcatttctttcctgttcatcttcttggtcatccttcttccgcaagggaaacgagcccaagcaaaaggcagtttcaatattaatttgaccgaggttttgtgcagtttattatcatccgggtaatcaggtgcaacccagtctgcctagcagcccccctatctctgctctgtgttttcatttaataaacattttggtctacttactatgtgctagattttctcgagaccaagtaaatgagatagaatctttatgctggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcaccagataatgcatacctgaacctggaaactgattcccactgcagaaagtgttctgagccacatcccttagcttcactagtgcaggtccacctgggaggatgtcccagcatcagcttgacccatgctgtgatcagccacctccatacatcacaccaagcaagcccctgggtgattcacagtctccaccaccagggcactgaccttaactctgtgtttttctagctccccatgaggacaccgtacacgacatcactaacgaggacgccacacacgacatcgctaacgaggatactgtacacgacatcgctaacgaggccgccgacaagggcatcgccaacgaggacgccgcccacggcatcgccaacgaggacgccgcccacggcatcgccagcgaggacgccgcccacggaatcgccagcgaggacgccgcccacggcatcgccagcgaggacgccgcccagggcatcgccaacgaggacgccgcccagggcatcgccaaggaggacgccgtccacggcatcgccaacgaggacgccgcccagggcatcgccaacgaggacgccgcccagggcatcgccaaggaggacgccgcccagggcatcgccaacgaggacgccgcccagggcatcgccaaagaggacgccgcccagggcatcgccaaggaggacgccgcccagggcatcgccaacgagggcgccgcccagggcatcgccaaagaggacgccgcccatggcatcgccaacgaggacgccgcccagggcatcgccaacgaggacgccgcccacggaatcgccagcgaggacgccgcccacggcatcgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggttggggggggagggatagcatcgggagatatacctaatgctagatgatgagttagtgggtgcagcgcaccagcacggcacatgtatacatatgtaactaacctgcacaatgtgcacatgtaccctaaaacttaaagtatatatatataaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacaaggcacgctaacgaggatgctgtacacgacatcactaatgaggacagtgtacaagccatcactaatgaggacactgtatatggcatcgctaacgaggacactgtacaaggcattgctaacgaggacgctgtacacaacatcgctaatgaggacaccatataagacatcaccaatgaggatgctgtatatgacatcgctaatggcacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgagccattgacactggagaatgatacgtaccctgaaataactcacttcctgaggaaaaagcgccatctctagggtacagaaacctgattctgggctccttttgggaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactgctttccacgtaagatccaattggagagagttcccaggggccttcggggtatccatgctgcttgggaggttaagggagggggcatgaaatcaaaacgaaacaggaaatatgtgtcatattggatttggtcttttccgggtttattggcataatagttggaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttcctccaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggccaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatga

SEQ ID NO: 28053 - DNA, 4858 bp, Homo sapiens
agccccttgcctcacaccggcccctcccacgctgagagaggtcagtgtgagccccttgcctcacaccggcccctcccacgtggacagaggtcagcgtgagccccttgtctcacaccggcccctcccacgctgagagaggtcagtgtgagcccttgcctcacaccggcccctcccacgcggacagaggtcagcgtgagccccttgcctcacaccggcccctcccacgctgagagaggtcagcccgagccccttgcctcacaccggcccctcccacgcggacagaggtcagcccgagccccttgcctcacaccggcccctcccacgctgagagaggtcagcccgagccccttgcctcacaccggcccctcccacgctgagagaggtcagcccgagccccttgcctcacaccggcccctcccacgctgagagaggtcagtgtgagcccttgcctcaccccggcccctcccacgcggacagaggtcagcctgagccccttgcctcacaccggcccctcccacgcggacagaggtcagcctgagccccttgcctcacaccggcccctcccacgcggacagaggtcagcctgagccccttgcctcacaccggcccctcccacgctgagagaggtcagtgtgagccccttgtctcacaccggcccctcccacgcggacagaggtcagcgtgagccccttgcctcacaccggcccctcccacgctgagagaggtcagcctgagcccttgcctcacaccagcccctcccacgcggacagaggtcagcgtgagccccttgcctcacaccggcccctcccacgctgagagaggtcagtgtgagcccttgcctcacaccggcccctcccacgcggacagaggtcagcgtgagccccttgcctcacaccggcccctcccacgctgagagaggtcagtgtgagcccttgcctcacaccggcccctcccacgcggacagaggtcagcgtgaccccctgcctcaacaggccaccgtgagggaggaacaggatcgcactcgggctgctgggaggtaggcagggacttgggcctgggaggtcgcggtggggcgagagctgggcctggagactcccctgggaggcaacagcggggtctgcagacacccttctccagccggagctgggactgttcagtcactgggagaagggatgtgggtctgaagagcttggttgcagaaactttggggtctacaaacgcaggcgggagctgagccaaaagagcttgtttgctgggaggtgggagatgcagccaggaggaacagctgggcaatgcgggaggcagaggccaggcctcctcaagttggcctctcagacccacttgcagcctcccggcgccccctccgggcccagctcttcctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28054 - DNA, 6289 bp, Homo sapiens
gcacaacctctgctcactgcagcctccacctgccaggctcaagcaattctcctgcctcagcctcccgagtagctgggattacaggtaagtgccaccacacccagctgatttttgtgttttttgtagagacgaggtttcgccatgtttcccagactgttctcaaactcctgagctcaaagcagtccacccaccttggcctcccagagttctgggattacaggtgtgagccatcttgctcattctagtttaaacttttgagtggtttgtgtctcctgattggactcctacaaatacagaattgatgctaggaagggtaccaggagatagacgcacacagatgggatttgggaataggtttggttatccaaggagcagtgctgagctccttgcaatgggatatgggatgctggtgatttccaggatgtgagctcacaatgactcaagctgccacatactgttgattgtgaaatgccagttgaagcatatgtcctgcgagcttaggggtgctacaagttgaccactgcagcagtaaagatgactctgaagaatggcgtgggttggttcctttcaaatgcacttgagcagcggtctccaaccacagggccacagagctggagctggatctaccatgaaagacttgtgaatccaggaagagagactgactgggcaacatgttattcaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28055 - DNA, 4240 bp, Homo sapiens
cagctcctccctcacggtggcctgttgatgcccaactcatgcctctggcaccctgcccagaggcgtgagcccctgcctcacactggctcctcccacgctgagagaggtcagtgtgagcccttgcctcacaccggcccctcccacgcggacagaggtcagcgtgagccccttgcctcacaccggcccctcccacgctgagagaggtcagtgtgagcccttgcctcacaccggcccctcccacgcggacagaggtcagcgtgagccccttgcctcacaccggcccctcccacgctgagagaggtcagtgtgagcccttgcctcacaccggcccctcccacgcggacagaggtcagcgtgaccccctgcctcaacaggccaccgtgagggaggaacaggatcgcactcgggctgctgggaggtaggcagggacttgggcctgggaggtcgcggtggggcgagagctgggcctggagactcccctgggaggcaacagcggggtctgcagacacccttctccagccggagctgggactgttcagtcactgggagaagggatgtgggtctgaagagcttggttgcagaaactttggggtctacaaacgcaggcgggagctgagccaaaagagcttgtttgctgggaggtgggagatgcagccaggaggaacagctgggcaatgcgggaggcagaggccaggcctcctcaagttggcctctcagacccacttgcagcctcccggcgccccctccgggcccagctcttcctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28056 - DNA, 6188 bp, Homo sapiens
tgcatgctggatgcagtggctcatgcctgtaatctcagcactttgggaggccaaggtgggaggatcgcttaaactcaggagtttgagaccagcctgggcaacatggtgaaaacctgtctctataaaaaattaaaaaataataataataactggtgtggtgttgtgcacctagagttccaactactagggaagctgagatgagaggataccttgagctggggactggggaggcttaggttacagtaagctgagattgtgccactgcactccagcttggacaaaagagcctgatcctgtctcaaaaaaaagaaagatacccagggcaagttaagttcggaggggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggttgcatggtaatcagccctcctcttgaagaaatttaggagcttgcagtcacccagtcatctcaacaacatccccaaatgcattcttaccatgctggagatcccaaagttcttagaggctcttgtgttagaaacctgggaccaagaccaaatattaaaacaaaagatgctcctgtcacatctatcactgaggtctttgtaagagctttagaagctctgtgccaggaaccagggacagagattaaatatatatttcttttcttttttttgagacagaatcttcctgtgccatccaggctggagtgcagtgatgtgatcatagctcactatagctttggccttctgagatcaagcaatcctcccatctcaacctcccaagtagctaggactacacacgcatgtcacccatgcccagatcatttttgtagagtcagagtttcaccgtggtggccaggttggccatgttggccagatggggtcttcttttgttgcccaggctggccacaaattcctgggctcaagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatcgaggttgcgctgtccttatgagaatctaatacctattgatctgttactttctcccatcacgctcaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28057 - DNA, 6780 bp, Homo sapiens
tgcatgctggatgcagtggctcatgcctgtaatctcagcactttgggaggccaaggtgggaggatcgcttaaactcaggagtttgagaccagcctgggcaacatggtgaaaacctgtctctataaaaaattaaaaaataataataataactggtgtggtgttgtgcacctagagttccaactactagggaagctgagatgagaggataccttgagctggggactggggaggcttaggttacagtaagctgagattgtgccactgcactccagcttggacaaaagagcctgatcctgtctcaaaaaaaagaaagatacccagggcaagttaagttcggaggggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggttgcatggtaatcagccctcctcttgaagaaatttaggagcttgcagtcacccagtcatctcaacaacatccccaaatgcattcttaccatgctggagatcccaaagttcttagaggctcttgtgttagaaacctgggaccaagaccaaatattaaaacaaaagatgctcctgtcacatctatcactgaggtctttgtaagagctttagaagctctgtgccaggaaccagggacagagattaaatatatatttcttttcttttttttgagacagaatcttcctgtgccatccaggctggagtgcagtgatgtgatcatagctcactatagctttggccttctgagatcaagcaatcctcccatctcaacctcccaagtagctaggactacacacgcatgtcacccatgcccagatcatttttgtagagtcagagtttcaccgtggtggccaggttggccatgttggccagatggggtcttcttttgttgcccaggctggccacaaattcctgggctcaagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatcgaggttgcgctgtccttatgagaatctaatacctattgatctgttactttctcccatcacgctcaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgcccttgcctcccaggggcctctccaggcccagctcttgcccccacggcggcctcccggggccaagtccctgctgggaggtaggcagggacttgggcctgggaggtcgcggtggggcgagagctgggcctggagactcccctgggaggcaacagcggggtctgcagacacccttctccagccggagctgggactgttcagtcactgggagaagggatgtgggtctgaagagcttggttgcagaaactttggggtctacaaacgcaggcgggagctgagccaaaagagcttgtttgctgggaggtgggagatgcagccaggaggaacagctgggcaatgcgggaggcagaggccaggcctcctcaagttggcctctcagacccacttgcagcctcccggcgccccctccgggcccagctcttcctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28058 - DNA, 5816 bp, Homo sapiens
ggattacagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28059 - DNA, 7455 bp, Homo sapiens
tgcatgctggatgcagtggctcatgcctgtaatctcagcactttgggaggccaaggtgggaggatcgcttaaactcaggagtttgagaccagcctgggcaacatggtgaaaacctgtctctataaaaaattaaaaaataataataataactggtgtggtgttgtgcacctagagttccaactactagggaagctgagatgagaggataccttgagctggggactggggaggcttaggttacagtaagctgagattgtgccactgcactccagcttggacaaaagagcctgatcctgtctcaaaaaaaagaaagatacccagggcaagttaagttcggaggggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggttgcatggtaatcagccctcctcttgaagaaatttaggagcttgcagtcacccagtcatctcaacaacatccccaaatgcattcttaccatgctggagatcccaaagttcttagaggctcttgtgttagaaacctgggaccaagaccaaatattaaaacaaaagatgctcctgtcacatctatcactgaggtctttgtaagagctttagaagctctgtgccaggaaccagggacagagattaaatatatatttcttttcttttttttgagacagaatcttcctgtgccatccaggctggagtgcagtgatgtgatcatagctcactatagctttggccttctgagatcaagcaatcctcccatctcaacctcccaagtagctaggactacacacgcatgtcacccatgcccagatcatttttgtagagtcagagtttcaccgtggtggccaggttggccatgttggccagatggggtcttcttttgttgcccaggctggccacaaattcctgggctcaagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatcgaggttgcgctgtccttatgagaatctaatacctattgatctgttactttctcccatcacgctcaggtgggaacatccagttgcaggaaaacaagcttaacacgcccactgattctacattatggtgagttccataattattttattatatattacagtgtaataatggaaataaagtgcctaataaatgcaaatgtgcttacatcttttggcccagctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28060 - DNA, 7135 bp, Homo sapiens
tgcatgctggatgcagtggctcatgcctgtaatctcagcactttgggaggccaaggtgggaggatcgcttaaactcaggagtttgagaccagcctgggcaacatggtgaaaacctgtctctataaaaaattaaaaaataataataataactggtgtggtgttgtgcacctagagttccaactactagggaagctgagatgagaggataccttgagctggggactggggaggcttaggttacagtaagctgagattgtgccactgcactccagcttggacaaaagagcctgatcctgtctcaaaaaaaagaaagatacccagggcaagttaagttcggaggggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggttgcatggtaatcagccctcctcttgaagaaatttaggagcttgcagtcacccagtcatctcaacaacatccccaaatgcattcttaccatgctggagatcccaaagttcttagaggctcttgtgttagaaacctgggaccaagaccaaatattaaaacaaaagatgctcctgtcacatctatcactgaggtctttgtaagagctttagaagctctgtgccaggaaccagggacagagattaaatatatatttcttttcttttttttgagacagaatcttcctgtgccatccaggctggagtgcagtgatgtgatcatagctcactatagctttggccttctgagatcaagcaatcctcccatctcaacctcccaagtagctaggactacacacgcatgtcacccatgcccagatcatttttgtagagtcagagtttcaccgtggtggccaggttggccatgttggccagatggggtcttcttttgttgcccaggctggccacaaattcctgggctcaagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28061 - DNA, 6896 bp, Homo sapiens
tgcatgctggatgcagtggctcatgcctgtaatctcagcactttgggaggccaaggtgggaggatcgcttaaactcaggagtttgagaccagcctgggcaacatggtgaaaacctgtctctataaaaaattaaaaaataataataataactggtgtggtgttgtgcacctagagttccaactactagggaagctgagatgagaggataccttgagctggggactggggaggcttaggttacagtaagctgagattgtgccactgcactccagcttggacaaaagagcctgatcctgtctcaaaaaaaagaaagatacccagggcaagttaagttcggaggggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggttgcatggtaatcagccctcctcttgaagaaatttaggagcttgcagtcacccagtcatctcaacaacatccccaaatgcattcttaccatgctggagatcccaaagttcttagaggctcttgtgttagaaacctgggaccaagaccaaatattaaaacaaaagatgctcctgtcacatctatcactgaggtctttgtaagagctttagaagctctgtgccaggaaccagggacagagattaaatatatatttcttttcttttttttgagacagaatcttcctgtgccatccaggctggagtgcagtgatgtgatcatagctcactatagctttggccttctgagatcaagcaatcctcccatctcaacctcccaagtagctaggactacacacgcatgtcacccatgcccagatcatttttgtagagtcagagtttcaccgtggtggccaggttggccatgttggccagatggggtcttcttttgttgcccaggctggccacaaattcctgggctcaagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatcgaggttgcgctgtccttatgagaatctaatacctattgatctgttactttctcccatcacgctcaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaatgtacgtataaaatataattttctaaccacttgctcgccaacaaggaaaacttttaagtagagcagaacctgaatagacaagacatttctttcttttggtagaaaatgatttaccatcactgtgtagttaattgtagactaggtaattttaactttgtgatttattgccggagacattttcttctgtactgtaaagtg

SEQ ID NO: 28062 - DNA, 7362 bp, Homo sapiens
tgcatgctggatgcagtggctcatgcctgtaatctcagcactttgggaggccaaggtgggaggatcgcttaaactcaggagtttgagaccagcctgggcaacatggtgaaaacctgtctctataaaaaattaaaaaataataataataactggtgtggtgttgtgcacctagagttccaactactagggaagctgagatgagaggataccttgagctggggactggggaggcttaggttacagtaagctgagattgtgccactgcactccagcttggacaaaagagcctgatcctgtctcaaaaaaaagaaagatacccagggcaagttaagttcggaggggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggttgcatggtaatcagccctcctcttgaagaaatttaggagcttgcagtcacccagtcatctcaacaacatccccaaatgcattcttaccatgctggagatcccaaagttcttagaggctcttgtgttagaaacctgggaccaagaccaaatattaaaacaaaagatgctcctgtcacatctatcactgaggtctttgtaagagctttagaagctctgtgccaggaaccagggacagagattaaatatatatttcttttcttttttttgagacagaatcttcctgtgccatccaggctggagtgcagtgatgtgatcatagctcactatagctttggccttctgagatcaagcaatcctcccatctcaacctcccaagtagctaggactacacacgcatgtcacccatgcccagatcatttttgtagagtcagagtttcaccgtggtggccaggttggccatgttggccagatggggtcttcttttgttgcccaggctggccacaaattcctgggctcaagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatcgaggttgcgctgtccttatgagaatctaatacctattgatctgttactttctcccatcacgctcaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacgatcaacgtgttctgttctggggaagggggcaaaggcagggtgaatcactttcttaaaaagtatagctcaagttgggagtgcagagggaatggggagaaaaccctcctgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccagcgggaagaggttgcagtgagccaagatcgcaccactgcactccagcctgggcgacagagcaagactcggtctcaaaaaaaaaaaaaaaaaaaaaaaaaaaaaggaaggccttactccgtcccaaactgaaaggattaaatggcttcacctgggagaagataaccatcctgccctccattgctacccccacatactgtccatgttctcagggggtactgtgagtcctgggatctttggggttgcccacctgcctgtgctagttatggagacccccaggtgttgaggcagggctggggtgtccccttccaaccaggctgtcaaggcaccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcactggtggggcagccagggcagcgtcaagagtctgagccagctgcaggacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtccaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcccgatgaagcacaaagttggagaaaaaaaaacgcaaactaaacaaccacaatgaaacagaacagagttaatctgctgtagctcaagagaggatgtacctgcccccaccccgcatccctgggctcgggtttgccttgctgacctctgctgccacctggtgccacacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggcgcttcaaggattctagataataaccccctttcccgaacatccaaga

SEQ ID NO: 28063 - DNA, 1486 bp, Homo sapiens
cggctggggcaggcacgctgtggctggctacttcccttcctcccatcccccttgggccaaacgggatcggtgcttctggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaagcgttttatttgaaaggataacttgtgttttggttattttgtattcccacctgtgctggtagatattattaacccattaggtaaatactattacagtcgtggtttctgcagcagctcacactgatgtagctggcgtttataactaccttctttcgctacccgtttcgcattccctttgccctgagatagcatgtcagttggtcatgatgcttggcctggcaggatgactcaaaccttcattacggaagagtctgaaccattagatatcctgcctggatggggttgctgtgattttccattaactctaatcgaaaaacacgggaggactaagaagctctctagacatatcacacatactcttcctgtgtccatgtgttctcattgttcagttcccacctatgagggagaacatgcggtgtttggttttttgtccttgcgatagtttgctgagaatgatggtttccagcttcatccatgtccctacaaaggacatgaactcatcatttttcatggctgcatagtattccatggtgtatatgtgccacgttttcttaatccagtctatcattgttggacatttgggttggttccaagtctttgctattgtgaatagtgccacaataaacatacgtgtgca

SEQ ID NO: 28064 - DNA, 2085 bp, Homo sapiens
ttttcttgcagatttatgaggatgagcctacaggccccacgcagactcctggagctggcagggcagagcctgctgggggaccaggccttggccatctccatcttggatgagctgcccagggagctcttccccccactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggtggaaacttcaagtgctggaattgcgggatgttgatgagaatttttggaccatatggtctggagccaggcccctgtcctgctccccagaggccatgagtaagaggcagacagtggaggactgtccaaggacaggagagaagcagcccttgaaggtgttcatggatgtttgcctcaaggaaaaattcatggatgaagatctgagcttcttctctgggtgggtccagcacagaagaggttcagtacacctgtgctgtactaaggtggtgaattattcaatgagcattctaaatttcagaaacatattggaaacagtatacccagacagtatccaagtgttggaaatttggaacatgtgctggccgtgtatgatagtagagtttagccgttacctgagccagatgaggaatcttcgcaaactcttcatctccgatggctgtcgttacctgctaagctctgacagccaagaacagttagttgctgaattcagctctgtgctcctcaggctggagtacctccagatgctttatgtaagaagggtctgcttcttcagaggccacctggaccagctgatcaggtgcctcaggagcccattggagacattggcattaacttatggcttcctagaaaaagtggacttgaaatgtctgccccggtacccaagtctcagtcaactgaagcagctgaatctgagtcatggtgcactgcgcttcatccgtcttgagcccctccgagctctgctagagaaagttgctgccactcttcagaccctcttcttagtggactgtgggattcgggactccaaactcagggtcatcctgcctgccctgagctgctgctccaacctcaccactttctgttttcacggcaatgacacgtccatggatggtctgaaggacctgctgcgccacacaggcaggctgagcaatttgagcctggaaacatatcctgcccctcgggagagtcttgatgacaggggtcgtgtcatttcggagctcctcaccccacttcaggctgagctgatgcgtatactgagggaagtaagggagcccaaaaggatcttctttggtccggtgtcctgcccttgctgtggcacgtcgcccactgagcaactggagttcaatttttgcttgtggggaaggcctgcctagtggggtggaggtataaaaagctttttctccaggcacttggaaactaaaatctgggacatagatgtcttttatttttctttttccttattttacaattttacagtttttatttaaaaatttgagacagggtttccctatgttgtccaggctggtctcaaactcttacgcttaagggagccacctgcttggcctcccaagattctgggattacaggcataagcagctgtgccgggtctataggtgcattataaagggaacagagaaacctctgtttcaggcatgtgctttctgtgagtggaaaacaaaaaatcccagcagggggcagcactggggaaaaagttgaatggagtcactgagactcagggatctgtgtcctagacagtcagaaatagaaagctgaagttctagagtgaaggagttatctcagcaaggatggatacaaagaaacgtcggaagtagagggaacctaaatggaaactctctgctgtccttcatgattgattagcctgtttcagcaatttatacatcagaaatctttagttcctgatgaattaaaaaaagaggtactagttcatctgtgatttaggttcatctgcaggaaataaaggaatcaaaataaacttc

SEQ ID NO: 28065 - DNA, 1716 bp, Homo sapiens
atggcagaaggtgatgtgggagctggcatatcacatgaagacagaggtcaggagtctgaagatgaaattgtggatgaaaaattggataccagttttaggatatcagttttcaaactacccatatacacttcaggttcattgaagaataatgcagtattgagagagaaaaaacaacatttttttcctgcatatcctcagccaatctatactactcatccaaagccaatcattaaaaaagacatacgattggagcggagtatgaaagagttttttgcaccacaaagagctggtatgaaactccgaacatttagtgatattgacaaatattacacagaacaaaagaagcaggaataccataaagaaaaagtaagagttgtagccatggcacaagttgctcgagaaagagttagagtagctgttaatgaacatttgaatcagaaaaaatatgctacacaaaaactaattgaagaaaataaagagacaattcagaacagtttacgacaagtttggcaaaacagattcaactaccttgaaaaagctagagagagaaaagctctgtttctaaaagaaaaatcccaaaaggcttcagagcgtttattagttcaaaacttaaataatgagcgcactcttttgaccagaggactacttaaaattgacagactggagaagaatgaggctgtcctaaaagagaaaagcctgattgttaagcaaaaactaaaagcagaaaaatatagaaagaatttacttaaagaaatgaaaaaagttagatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttccttgaagactgtaagatttttgtatatttacttttgatgggtttgccctgtttggtatacatgtgaagacagggaaaagacagaggagagaagcaagagacaacccatataattatatattggaatcataaaatatacagaaatggtatatattaaccataagtctgtttaatacataccaatggtagaaaatttgaaaaataaactgttaaaaaagaca

SEQ ID NO: 28066 - DNA, 401 bp, Homo sapiens
atgaggaaagagaccactcactcgagtcctgcagctgtgttaggtcctctggctctagaaacagcaagagtctccgcaccccacttggaaccatatgtgaaggatgtgatgacagtagcatttttagccatcttgatcacagctccaaatggagctctacttatgggcattctggggcctaaactgcttacacgccattatgatccaagcaaaataaaactgcaattgtcaacattagaacatcattaaaaagtttacctgtcatcatctgcctgctgcttttaatgaattatttcacaagacagaagaattttaaagtagaaatatgtagggactgtacagaaaatccaggatttagtaaacatgtgatttcagtacagggcttttcttggactttttac

SEQ ID NO: 28067 - DNA, 397 bp, Homo sapiens
atgacaagagtgcaacatcagcccaaaaatgctgtgttaggtcctctggctctagaaacagcaagagtctccgcaccccacttggaaccatatgcgaaggatgtgatgacagtagtatttttagccatcttgatcacagctccaaatggagctctacttatgggcattctggggcctaaaatgcttacacgccattatgatccaagcaaaataaaactgcaattgtcaacattagaacatcattaaaaagtttacctgtcatcatcggcctgcttcttttaatgaattatttcaatgacagaagaattttaaagtagaaatatgtagggagtgtacagaaaatccaggatttagtaaacatgtgatttcagtacagggcttttcttggactttttac

SEQ ID NO: 28068 - DNA, 1716 bp, Homo sapiens; identical to SEQ ID NO: 28065

SEQ ID NO: 28069 - DNA, 3588 bp, Homo sapiens
ggcgggcgcccctcccccagcgtcactgccgccttgcagtttgatctcagactgctgtgctagcaatcagtgagagtccgtgggcgtaggaccttccgagccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaatgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatcctccaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagtaagtgacatgcaggcacctctctttcatcctttaagggaccttccacctgccatgcgcactctccagcagaatgtctgcttgtgtctagatggggaaggagcaggttcatcgggtactgggacccagcagtgtgatccagagagcagtgggagacgctggcagcaggaggtaaatgctctctgtgctctcagggacacctcctctgatatgctgaggccagtgttggggacctttgcctacatactggtattgtcctttccttgaagttttgcagtagggtctcctgtcccagggggttgaggaaaaaaaacaccagttgtttatattttgtgcttattcatacaagacaggaagcacggtcttaggcggatggaggcctgacgtccctggagttgaaagcccagtttctgacacacaggcctggcaggcaggactccttgtgctcccagcagctcagacagggaaaggatagtccccactcacggtgacaccaccttcctgaggcttccctcctgctgctaccactgatgcgagggaaaggccagtggctggagaccccatgtgcagttcttggatactctgggaggtgttcccctccctcccatgactgagcccatcagccattcctgaaggaagacagtggtagccacaggaacggtggccatttccaagctccctgccctctgctcacccatgtccaatctctcaggaccccgtggaattgcatcttctgcaggatgaaggagtctccgggaagccaacagtgttgtcaggaatctgaggtcctggagaggcagatgtgtcctgaggaacagttggtaaatcagatgcaaaccccaagccttctcctttcccctcacacgtgagaaccatgaacaagcgcaagggcaggggaatgtactgaaaggagcctgctcttccgcgccacacttcaatggcactgatagaacaccacaccttgtttgcacaaaaaataactcagccatgacatgtctgtttccaagagccacacatgttagagaaacttgaggaagaagggtgtgagtcgtgtgctgtgtctcatgcatgtgggctcattctctccaagctgcttttcatttacggcctctttcttttgcagaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaattttttttcctcctgtc

SEQ ID NO: 28070 - DNA, 3256 bp, Homo sapiens
gcttgtcccaagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagagcatatcagaattatctttagattcaactcttcatgccgtcaatcttcattgcaataacatctccaagatcgaagccattgatcatatttggaatttacaacatctagatctgtcatctaatcaaataagtagaattgaaggactaaacacactgacaaaactgtgcacattaaatttgtcctgcaatttgattacaaaagtagaaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagcaaaaaaaaaaaaaaaa

SEQ ID NO: 28071 - DNA, 4439 bp, Homo sapiens
gcctggtattattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggccatggaacagatcaatagctgcacagctctacagcatctcgatttatcagacaataatatatcccagataggtgatctatctaaattggtatccctgaaaaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaagtttgaaagctgaatggctctatagtcaaggcaaggggagagcatatcggcctggccagcacatccagcttgtccaatatctggctacagtctgccccctcacttctacactaggtcttcaaactgcagaggatgccaaactagagaagattttgagcaaacagaggtttcaccagaggcagttgatgaaccaaagccaaaatgaagagttgtctcctcttgttcctgttgaaacaagggcatcccttattcctgagcattcaagccctgttcaagattgccagatatcccaggaaagtgaacccgtcattcaagtgaattcttgggttgggataaacagtaatgatgatcagttatttgcggttaagaataattttccagcctctgtacacactacgagatattctcgaaatgatctgcacctggaagacatacagacggatgaggacaagttaaactgtagtcttctctcttcagagtctacttttatgccagttgcatcaggactgtctccactatcacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggagattacgaaaagaaagagatgaagaacgtattaaaaaatttgtacaagaagaagctttcagattcctttggaaccaggtaaggtctctacaggtttggcaacagacagtggaccagcgtctaagttcctggcatactgatgttcctcctatatcaagtactcttgtgccatcgaaacatccattatttacccaaagccaggagtcctcttgtgatcaaaatgctgattggtttattgcttctgatgtagctcctcaagagaaatcattaccagaatttccagactctggttttcattcctctctaacagaacaagttcattcattgcagcattctttggattttgagaaaagttccacagaaggcagtgaaagctccataatggggaattccattgacacagtcagatatggcaaagaatcagatttaggggatgttagtgaagaacatggtgaatggaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaagggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagcaaatataaatgagaaatatgaggattgtgaattattgaaatttgccagtctccctggtgtaaaatgtttttttaaagccttttttcctcctttcggagtcaaggaaagcctttctataagcaaattaaggaagaaaaggtaggattataagatttctcaatggggatgattaaattgtctcatggaaaacttcagttaatgtcatgcatcagttttaacatatgaagtaaagtgttctatccaggattaaagtcaagtttacttaggcaacacaagaatatttcacttagatatgaagaaaggaaacactagtctccattcacttgaaatactctcatggcaaatatttatcctctcattaagtgctttttcaccctataggtaagcatttttgtgccaacatgttgtcagaaattaatgtatgttcatctcctctgttcctgcttatttttacttatatatttcagcagaaggtccgtggccattcacttcaattttgacctctgtcccatagtgaagaacatttaaagtaatactactggtcgaatatgaatgactttttaggaactactttttgtctaacctgaaaaagttccacatttggaagacaatttaatgatggtgaagaaataataaacctcactttacttgttaaaagggatatatatatatatatatatgtctgcaacttcagggagaaataagattgtgtttgaatattgtaggtagatgcatttgtaattaaggataatatcgtttaacaacatgtatttggtttccctcaacttacagacatacagctatttaaaactatggcaatacttaagcatctctaaatttaggtgctaaatatctattattctgttgtagtcattaggtgcccttctctgaagttatgtaaaataaaagcatctgatccttcaaggataaagttgaggatcacatggtacgtggcatttgttgttattgttttttaaagagatggaggctggctctgttggtgcggtgccatgatcatagttcactataacctcgaactcctggctcaagtgatctcccacttcagcctcccgagtatctgggattataagcaagagccactgctcccagctcatggtatttgttgatagtcataacatttttcctgtatggtaagacgtatttttctcagtttataaatacgtagcactcaggttgagacgacttggattttattcttagaaatccagaatcccttgaaaaggaaatattttctgtttcttataaataaaagagtaatcttactttcagaaggattttccttagtgaaacatgtgtaacattgaatgcatgttaaataaaaatggaatttctaactttaaaaaaaaaaaaaaaaaaaaaaaaaaaa

SEQ ID NO: 28072 - DNA, 2932 bp, Homo sapiens
ggagagacatgcgattggtgaccgagccgagcggaccgaaggcgcgcccgagatgcaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtg

SEQ ID NO: 28073 - DNA, 2792 bp, Homo sapiens
aatttagagaagatgtagggagtgttcaacatgttcgttgtggaagagaaagagctaagagagaggagcttaaagacacaaacgggtagaatcaaggagtgtgctctcaaatgagaggaacaggagtgacattaaccttgaaatgctcggagactctactccttcatgacagtaggaggataattaacaatagatacaaatgcaggaattgatgagtgccatcagaaagctgtatcatgagctgcctgcacttctaaagtgtccagtggatttttaatcacatgagcctggaaatagggttatgaaaagaagctcagagcagagcaccgaaagtggccactaccagcatgaagagcccaacaattcaaactggtgaagtgagaaaaacagaatgcagctttcaaggttcgtttcaagcagttggcttgtgggactctgagagatgctgctgcccatgacatgcgggaattatcatgatcaactacccagcttggatttcatccagtggccaagagctttgtgtgggagacggcaagggttggatttttcaaaagagtaaaccaggataaatcatgaggaacctataacccttttggccacatgcaaaaaagcaagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggagaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaac

SEQ ID NO: 28074 - DNA, 5324 bp, Homo sapiens
ggggcccgtctggggcgccggcgggtgcgtttgaatctggtccgagcgcgggaaacggcgggtccccgagcccagggttacaaaataaatgccatttgaacagtgccgtctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatatgaggacttgctgtgttgcccaggctgggctctaactcctggactcctggactcaatctatccttctgcctcagtcccaattggctaggactgcaggcacacaccaccagacccagctaatgtaatttctatccatatgtgtctttatatttaaagtggtttttttatagacagtatataaatgggtcatgttttttgatcttctctgacaatctgtcttaaaattggtgcatatgtaccatattcaaagtgattattgatatagttggattaatatccaccatatttgttactgtcttctatttgttccccttgttatttgttcctatttctgtcttccactccttttctgtcttttgtggttttaactgaacattttatgatgccgttttctttcctagcatatcagttatacttttttttttttaaacctttcttagtggtttctttagagttggaatttttatttgtttttatctttcttagtggttgctttagagttggagttttcgtttataactaatccacgtttgctttcagatgacactataccactttgcaggtagggtggtatataataacaaaataatcctaatccttgcctctcgttccttgtatcattgctgtcattcattttgctaaggtataagcagacataagcatacataattgaatatattgttgctattattattttgaacaaactacatcttaggtcatttaagaataagaaaaataaaagtttttatttaccttcacttactccttctttgatgcttctcctttgtttgtgttgatccaaattctgacctatattcttttccttccctccagagaacttcttttaatgcttctttcaaggcatgtctactggcaactaattctcttaattttggtttgtcagagagtcttttacttctactttatttctttgcagggataatgttatgtagtttataattctagttgatgaatttttttctctctgtactttatttaatttattattattattttttgagacagagtcttgctctgttgcctagggtggaacgcagtggtgtgatctcagttcactgcaacctctgcctcctaagttcaaacgattcttgtacctcagcctgctgagtagctggtatacaggcacatcgccgccacacccagctcatttttgtattagtggagacagggcttcaccatgttgcccaggctggtctcgaattcttgatctcaagtgatctactcgcctcagcttctcaaattgctgggattactccccgtgcccggccactctctgtactttaaacatttcgctatactctcttcttggctcgtgtagtatctgagaaataggatataattctttttttgctcctcagtagataaggcgtatttttccctatctggtttctttcaatactttttctttgtttgatttttctgtaggttgaatatgatatgcctaggtgtagttttcttttctttttttttttttttttggcatttattctattcagtattctatgagcttcctggataaattctcagttattattgtctgaatatttcttctgttcctttctctcttctgaaattcttattatacatgttaacaccttttacagttgtctcacaggtcttggatatttcattctatcaaaacagctgcatttttgagttctgtttgctaatattttatttgagaatgtttgcattaggtttgaaataagattaaatggttgttggttgttttgttaaaaaaaaaaaaaaaaaaaaaaaaaaaaaaaaaaaaaaaaaaaaaaaaaaagaaaaaaaaaaaaaaaaaaa

SEQ ID NO: 28075 - DNA, 1837 bp, Homo sapiens
cttgtctttgtgtcggttgtgattttcctaatctctgattttccttttctctcggacgctctccctcttcggacccattttctcccgtgcttcatgccctgatagcctggccccttcccggcttccttcgctaccggggacgcctctagtttttctgaatttctggctggctccaccctccgcgttcatcttcctcaagagttcgcccctctgggggctcctctgtgtaatcgtcgccttctctgggtatttctgtgaactccgtctcacaccatcccgccatcttctctgccttggccccttttctctgtacagccagctctgtgtccttttcttctccccctctaaaatcgactcctcttctccctgagagccccacctttgtgccccactcctcattttcctacgcctccctctctctgctggtcctctctctccctgcaaggttccattccatcaatttgtttgtcttttgtaggggtggcatcccctctgactactgctccatccttttttttttttttttttttttttttgcttgaggatttcacttcaatcttttctggttgcgtctccacttgtactcagcttgttaggtccaggtccagttgttctgcatctgaggctggcgtgtgctgtcttctctgattggcctaatctccctcacccccgtgagatctgttgtcagccttcgtttctctttcctgtgtcccagcttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatccccactctgcctcgggctggagctcttttgtgctatgaagcaacagcctcaagattcagagctgttgctttccataactggaagtggcttctgatgaggaacatggtgtgtaagctgcaagagggctgcgaggagacgctagtgttcattgagacagggactgcaaggggagttgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttcccttaaaaaaaaaaaaaaaaaaaaaaaaaaaaaaaaaaaaaaaaaaaa

SEQ ID NO: 28076 - DNA, 822 bp, Homo sapiens
tcttgagctaggaaaggattactcgcgcctcgttagaatcagacatggcttcaggggatgcaggacgctcccctgagctgcctgtcaccgactaagtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattggcaaggctggaagaaacattgtgagggcagagacctgtccgagtggaaaaaaggctgtgaggtttcctaaactggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtcttcaaaaaaaaaaa

SEQ ID NO: 28077 - DNA, 872 bp, Homo sapiens
gagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcagatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactcttctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaatattaaagcactcgctctgc

SEQ ID NO: 28078 - DNA, 1731 bp, Homo sapiens
ttagggcgggagcccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataaccaagcaactgtgttacaaaacctttatagatttattcatcccaacccagggaactggccacctatctactgcaagtctgatgatagaaccagagtcaactggtgtttgaagcatatggcaaaggcatcagaaatcaggcaagatctacaacttctcactgtagaggaccttgtagtggggatctaccaacaaaaatttctcaaggagccctctaagacttggattcgaagcctcctagatgtggccatgtgggattattctagcaacacaaggtgcaagtggcatgaagaaaatgatattctcttctgtgctttagctgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaagaggaattacccgcttactagagagcatttccaattcttccagcaatatccacaaattctccaactgtgacacttcactctcaccttacatgtcccaaaaagatggatacaaatctttctcttccttatcttaatgatggtactcttttcaatttctgaaaacagtaacaggcccaacttccttcttactacagtcatattaaacagatcacatcaatgacaaatgtcactactataaaaactacttaatttgtaaggaaattgtttcatagatttaaaaaaattgtggttggagagcatcttggcatttgtgctttttttcttgagggattgttctgcttcctggctgtatgatgggtatatcattaaagtttggagtcctatatgaacaaaactgacatttttagagttgtacttttgggaatgttatagattgatcattctttctcctgataataaaggtattgaatatctgttatgaaaggttct

SEQ ID NO: 28079 - DNA, 1865 bp, Homo sapiens
agtgttgcaactgggcctggcatgtttcagtgtggtgtccagcagtgtctcccactccttgtgaagtctgaggttgcaaaaggactgtgatcatatgaagatcatccaggagtacaactcgaaattctcagaaaacaggaccttgatgtgagaggagcaggttcaggtaaacaaagggcgaggacccgagcgagcttaaggagtggggtgcagcgtctggtcagccgagggtgaattctcaggactggtcgggagtcaaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcataagagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatta

SEQ ID NO: 28080 - DNA, 1722 bp, Homo sapiens
ttccgctttgaaggcgaggaccccagcgagcgtaagggcgcagtgtccgcctggcggatttgggtcagcaggcggaagtcgtcccaggctgctagatactaaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcataagagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaattaaaaaaaaaaaaaaa

SEQ ID NO: 28081 - DNA, 1782 bp, Homo sapiens
agtgttgcaactgggcctggcatgtttcagtgtggtgtccagcagtgtctcccactccttgtgaagtctgaggttgcaaaaggactgtgatcatatgaagatcatccaggagtacaactcgaaattctcagaaaacaggaccttgatgtgagaggagcaggttcaggtaaacaaagggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcataagagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatta

SEQ ID NO: 28082 - DNA, 2021 bp, Homo sapiens
gctttcccgacggccatcttgggaatctgacggatcggaggcatttgtgaggaggcgcgaatcaagttagcggggggaagagtcttagacctggccagtcctcagggtgagggccctgaggaagaactgagggacctcccaccatagagagaagaaaccccggcctgtactgcgctgccgtgagactggtgctccaggaaccaggtggtgacgaactgggtgtgaggcacacagcctaaagtcagcacagcagaggaggcccaggcagtgccaggagtcaaggcctgttggatctcatcatccatatccctgttgatacgtttacctgctgctcctgaagaagtcgtcatgcctcccgttccaggcgttccattccgcaacgttgacaacgactccccgacctcagttgagttagaagactgggtagatgcacagcatcccacagatgaggaagaggaggaagcctcctccgcctcttccactttgtacttagtattttccccctcttctttctccacatcctcttctctgattcttggtggtcctgaggaggaggaggtgccctctggtgtgataccaaatcttaccgagagcattcccagtagtcctccacagggtcctccacagggtccttcccagagtcctctgagctcctgctgctcctctttttcatggagctcattcagtgaggagtccagcagccagaaaggggaggatacaggcacctgtcagggcctgccagacagtgagtcctctttcacatatacactagatgaaaaggtggccgagttagtggagttcctgctcctcaaatacgaagcagaggagcctgtaacagaggcagagatgctgatgattgtcatcaagtacaaagattactttcctgtgatactcaagagagcccgtgagttcatggagcttctttttggccttgccctgatagaagtgggccctgaccacttctgtgtgtttgcaaacacagtaggcctcaccgatgagggtagtgatgatgagggcatgcccgagaacagcctcctgattattattctgagtgtgatcttcataaagggcaactgtgcctctgaggaggtcatctgggaagtgctgaatgcagtaggggtatatgctgggagggagcacttcgtctatggggagcctagggagctcctcactaaagtttgggtgcagggacattacctggagtatcgggaggtgccccacagttctcctccatattatgaattcctgtggggtccaagagcccattcagaaagcatcaagaagaaagtactagagtttttagccaagctgaacaacactgttcctagttcctttccatcctggtacaaggatgctttgaaagatgtggaagagagagtccaggccacaattgataccgcagatgatgccactgtcatggccagtgaaagcctcagtgtcatgtccagcaacgtctccttttctgagtgaagtctaggatagtttcttccccttgtgtttgaacagggcagtttaggttctaggtagtggagggccaggtggggctcgaggaacgtagtgttctttgcatttctgtcccatatgggtgatgtagagatttacctgtttttcagtattttctaaatgcttttcctttgaatagcaggtagttagcttcagagtgttaatttatgaatattagtcgcacatgtattgctctttatctggtttaagagtaacagtttgatattttgttaaaaaaatggaaataccttctcccttattttgtgatctgtaacagggtagtgtggtattgtaataggcatttttttttttttttacaatgtgcaataactcagcagttaaatagtggaacaaaattgaagggtggtcagtagtttcatttccttgtcctgcttattcttttgttcttgaaaattatatatacctggctttgcttagcttgttgaagaaagtagcagaaattaaatcttaataaaagaaagccccactaaaaaaaaaaaaaaaaaaaaaaaaaaaaa

SEQ ID NO: 28083 - DNA, 3830 bp, Homo sapiens
ggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaa

SEQ ID NO: 28084 - DNA, 3941 bp, Homo sapiens
tcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttcaaaaaaaaaaaaaaa

SEQ ID NO: 28085 - DNA, 3484 bp, Homo sapiens
ggtggctggttctgcgccggatccgggagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttaaaaaaaaaaaaaaaaa

SEQ ID NO: 28086 - DNA, 4020 bp, Homo sapiens
caccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaaaaaaaaaaaaaaaaaa

SEQ ID NO: 28087 - DNA, 6113 bp, Homo sapiens
taatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaacatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtc

SEQ ID NO: 28088 - DNA, 3704 bp, Homo sapiens
ctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaaaaaaaaaa

SEQ ID NO: 28089 - DNA, 3710 bp, Homo sapiens
ctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagtaagaactttagccttaggagatgtaaataaagtagtatttgaagaagcacaggagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaaaaaaaaaa

SEQ ID NO: 28090 - DNA, 1961 bp, Homo sapiens
ttatgccggggagggctgagctatcgctagggaacccacggtgactgaatcaaagggaagaaagacccaagacctggatctcccttttacatggaccctaaagcaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaacgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaaaaaaa

SEQ ID NO: 28091 - DNA, 705 bp, Homo sapiens
ctgccgcccgcccagacgccagcaagcccccctcccacgacagggctgctccgggagcttcggagacccgccccgggcctgagcgcaggctgcctccgggaccccacggctgtccggacgtgccatgggcgcgcagctgccgggcaacgtgttgtgtaagtgaacatctgggaggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatattgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagcaaaaaaaaaaaaaaaaaa

SEQ ID NO: 28092 - DNA, 195 bp, Homo sapiens
atgaaacctcactcctaccggccgctcatgctgaggagagcggaccgggacacagcagcggacccgaaagagcgcagactcgggacgaaccggccgctctgccccggacacagcgacctcgggccctccccgcaaacactcctttggactcccagattcgcagccttgtgctgcagcgccacacaagaaaactga

SEQ ID NO: 28093 - DNA, 195 bp, Homo sapiens; identical to SEQ ID NO: 28092

SEQ ID NO: 28094 - DNA, 2283 bp, Homo sapiens
tataaatagttgctccgtgggctttccgcatttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgaggcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccatgtggggccagatcaagaagttgacacagatggcggaagaaaatctgaagaaagcggatgaccagctacaatgagtaatctaatgtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctgtttgtggctctcagctctcaaggctgttttccccctgattcccactttgcactttatttctgtgtgtttgtcttcattcctctagcaccactgggttggggtctccttgaccaagctggtctcggcacatatgcatgtatgcccaggtcctgaaatcagccttgtggagcctgtgggtaggaaaagtcaaccctctgtgcatgtaggcctggaacctgaccaatactgtattttcctaccacgtttggtttcaaatgtggaaactgcccatacggacctactgcatttgtttttaaaaatcctctgtaagtggacctgcacagttcaggcccagattgttccaggatcaaccctacagtagaaatcaagtatctttttcattgtctcttgggatctgccttttcaccaataaaatatgagggctgttgggagcaggcccccccaaatctggccataaactgtccccaaaactggccataaacaaaatctctgcagcactataacatgttcataatggccataacgcccaagttggaaggttgtggatttacaggaatgagggcaaggaacacctggcctgcccagggtggaaaaccacttaaaggcattcttaagccacaaacaatagcatgagtgatctgtgccttaagaacatgctcctgctgcagttaactagcccaacatattcctttaattcagtccatcccttcgtttcccataagggatacttttagttaatttaatatctatagaaagaatgctaatgactggtttgctgttaataaatacgtgggtaaatctctgtttggggctctcaactctgaaggctgtgagacccctgatttcccacttgacacctct

SEQ ID NO: 28095 - DNA, 2319 bp, Homo sapiens
accatgggtgaattatgaatcagtagctatgccaggcctcagctgggccacatctggagaactggggtgagggcacaacatcacaaaatatctggccccagtctggtcactcatcccttttagggcaacaaggaaactatcctgtggcctgagagcacaatacctgagacaaaggccagcagaaacatttgtctgccctcaccctttctgccccagcttccacctgctccccatctgcccacccactaaagcccatgtggcatgccatctctcgaacatccaggatgtcccagagtggatgtccatcaggtctgctggcagacaaaaatatctcttcaagtgccactcgagtgatagtgaagactgcaggcaaccagaaagactttatggtagctgatgacatctcggtaaggcagttcaaggagatgctattggctcacttccaatgccagatggaccaactagtgctggtcttcatgggttgccttctcaaagaccatgacacactgagccagaggggcatcatggatggccacaccatctacttggtcatcaagtccaagcagggctccagatctctagcccattccttccgggacctgccaacgaatgatccctgccaccgggacagaaacaccaaaggaaacagcagcagagtgcaccaaccaactggtatgaatcaagctccagtggaactggcccactttgtggggtctgatgcacccaaagtgcatacccaaaacttggaagtgagccacccagagtgcaaagcacagatgctggagaatcctagcatccagcggcttctgtccaacatggagttcatgtggcagttcatttcagaacatctagacacgcaacaattgatgcagcagaacccagaagtttcccgccttcttcttgataattctgagatcctattgcagactctggagctggccaggaaccttgctatgatccaagagataatgcagatccaacaaccttcacaaaaccttgagtatccactgaacccacagccatatctgggcttagagacaatgccaggtgggaataatgccctgggtcagaactatgctgatatcaatgatcaaatgctgaacagcatgcaagatccttttggaggaaaccctttcacagctctcctggcaggacaagtgctagaacaagtccagtcttcacccccacctccaccaccatcacaggaacaacaagaccagctcacacagcatcctgcaacccgagtcatctataatagctctggtggtttctcttcaaacacctcagccaatgacacccttaacaaggtcaaccacacttccaaagccaacactgctatgatttccaccaagggccagagccatatctgtgccactcggcagccagctgggataccagccttacctagcatagagcttacccagcagcttcaagaagaatacaaggatgccactgtttctctaagtagctccagacagacattaaagggtgatctccagctgtcagatgagcagagcagctcccagatcacaggaggcatgatgcagttgcttatgaacaacccctacctggcagctcagattatgttgttcacaagtatgccccagctgagtgaacagtggaggcagcagctgcccacattcctgcagcagacacagatttctgatctgcttagtgcttaggcaaccctaaagcattccaagcaatattgcagattgagcaggccctccagctgctggccacagaggctcctgttcttctgccttgggttgcaccctacctatggggcctgggttggcttcctgcccccagctgcagctatcctgacacagtgccctgttcctggaatgtttcagatacagctgagcccaagggacctgagtgctgccacaagcctggaacagtcctgcagaggctacaatccccggatggggacccttcccaccctctgcaagctcctgagatttgttttagcaaacagatggattctctccaggccatgggatttgggaaccaccatgccaatctacaggcactcattgctactgaaggggacaccaatgctgctatccgcaagctcaagagatcccagagattctaaccaccatgcctacttgtttgcttgctacctgcctgctgacccacctgaccatctcatttgccttttgcacctttcctgatgcttccagccaggagaagtcctggaataagagttatcaaccaatgtgtcttgtactgaataatagatcattggtcgtggctgaaacatctgtcaataaaatggctacactcacttgctgcgaaaaaaaaaaaaaaaaa

SEQ ID NO: 28096 - DNA, 2392 bp, Homo sapiens
ggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagcagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggttaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggaaaaaaaaaaaaaaaaaaaaaa

SEQ ID NO: 28097 - DNA, 2462 bp, Homo sapiens
gctctgaccgactggtcccctaaacggtggcggcggtttttggtcgttgggccccgggatttaggaccaacatttgaagacccgaaggggaactgcaaccatgaatgaagaaaatatagatggaacaaatggatgcagtaaagttcgaactggtattcagaatgaagcagcattacttgctttgatggaaaagactggttacaacatggttcaggaaaatggacaaaggaaatttggcggtcctcctccaggttgggaaggtccacctccacctagaggctgtgaagtttttgtaggaaaaatacctcgtgatatgtatgaagatgagttagttcctgtatttgaaagagctgggaagatatatgaatttcgacttatgatggaatttagtggtgaaaatcgaggttatgcttttgtgatgtacactacaaaagaagaagcccaattagccatcagaattcttaataattatgaaattcgaccagggaagtttattggtgtgtgtgtaagcctggataattgtagattatttattggagctattcccaaggaaaagaagaaagaagaaattttagatgaaatgaagaaagttacagaaggagttgtagatgtcattgtttatccaagtgcaactgataagaccaaaaatcgtggttttgcatttgtggaatatgaatctcacagagctgctgctatggcaaggaggaaactaattccaggaacattccaactatggggccacaccattcaggtagattgggctgacccagagaaagaggtggatgaggaaaccatgcagagagttaaagttctttatgtaagaaatttaatgatctcaactacagaggaaacaattaaagcagaattcaataaatttaagcctggtgcagttgaacgggtaaagaaacttagagattatgcttttgttcactttttcaaccgagaagatgcagtggctgccatgtctgttatgaatggaaaatgcattgatggagcaagtattgaggtaacactagctaaaccagtaaataaagaaaacacttggagacagcatcttaatggtcagattagtccaaattctgaaaatctgattgtgtttgctaacaaagaagagagccacccaaaaactctaggcaagctgccaactcttcctgctcgtctcaatggtcagcatagcccaagtccgcctgaagttgaaagatgcacttaccctttttatcctggaacaaagcttactccaattagtatgtattctttaaaatccaatcattttaattctgcagtaatgcatttggattattactgcaacaaaaataactgggcaccaccagaatattatttatattcaacaacaagtcaagatgggaaagtactcttggtgtataagatagttattcctgctattgcaaatggatcccagagttacttcatgccagacaaactctgtactacgttagaagatgcaaaggaactggcagcccagtttacattacttcatttggactacaatttccatcgcagctcaataaatagtctttcccctgttagtgctaccctctcttctgggactcccagcgtgcttccttatacttcaaggccttattcttatccaggctatcctttgtcaccaacaatatcacttgctaatggcagccatgttggacagcggctatgtatctccaatcaggcctccttcttctgaagaaaatactaacattagtatgaaaatttgtgtaaatttgtagtatgaaaacttgcaaattaaaatattgttttattttagaatcgggtttgcatatttggttttaaaaaggtatttattccaaagtactaaacatcagctataattcagaataacatggagttgtagaatttataaaaatgcaaagtttaaaaagttattcagtggtttctcttgataaaggtacagcaaactactattctttttaaacttctaggattttcttctactttctgagtgggcaatagaacctagtcatttatgttttttttttttttgcataattttactaaatagtatttcacaaatattaaagcacttgaagacaatggttatagtagatttgattaccaaggatcactatctgtactggagattagaacaattatatgaccagaagcatctaaccattatgtaaaaagaaatgatgagacaaaaagattaagatacaaattttgtgcagtactaaagaaaaagcagtctaccattgtggtccttgaaaataactatagatatttttgttatttgttagacacaaattataattttgttgttaatgtatttaagcattttatagttatgctttgtgtttttgatattctttgtattgttaataacaagtgttatgggtttttaatgttgaaatcatgtgttaatttttgtacttgaattcaaattttttgacattaaatatgtgatgcttctaaaaaaaaaaaaaaaa

SEQ ID NO: 28098 - DNA, 983 bp, Homo sapiens
agtgtcagccacctcccacccaagccactagcaagactccacaatgtcagagcaacaaatggacctgaaggatttaatgcccacaaagaggaaatacatgtggaagactgctgaagataggcgcatgtctgacctcacctgtgtgctggagtggctggagcggaggcaggggaagaagaaacaagctcccgagaagcaaaagcccaaagtggtgacagtccttaaacgaaataagaagaaggaagagaagaaaggcaaaggcctcatgacagcacggggagggaaccgcagggacacggagacttcccagcaggccttaggaaagagattcaggaaggacgccgcctcctaccgaagcctctatggagtggagcaaaaggggaaacacctcagcatggtccctggcagctacatcaaggatggccccaagaaatctgatacagacatcaaggatgcagtcgacccagagtccactcagcggccaaacccattccgtcgacaaagcattgtcttagatcccatgttacaggagggtacctttaacagccagagggcaaccttcataagagactggtccaacaagatgcctgacatggcttacgaacgcaagctaaagagcctcatggagaaaagcaccgaacctaagatggaaaccatgaggatgttgaagccagaggaggtgctgagctgccgatacctgaggttatccaaggagaacattcggaccttgctcaagttgtgcaaggatgcaggaatgaatgtggatatccacccccacatggtcgaagaggacatagatgctaaaaaggtgttcaccggaatacccagcatggccctctaaatagctcctctcgccaccaccttcaggctccttctgtcatgggacccttcacctccagatgccatcctctggcacactacaagtggtccttccaacttagtgcatccctttagaaagtaagcaatcagaaaaaaaaaaaaaa

SEQ ID NO: 28099 - DNA, 1435 bp, Homo sapiens
atagattgcgggcccacccctccccctgtctgcctgccctccccactggccgggcctcaacctcttctccccacaaccccaaccccagaggaaaagccccctcacctggcgtcccgcaaccatggatgcaagtcgccccaagtcctcggaatcccagtcctccctggaggcccccaggcccggcccaaaccccagtcccaacgtggtgaacaagcccctgcagcgggactcccccggcatggtggccgacaggctgccaccaaagaccggcgcggtggttattgacatgggcacaggcacctgtaaggtaggttttgctgggcaggccagccccacctacaccgtggccaccatcctgggctgccagcccaagaaacccgccacctcggggcagtccgggctgcagacgttcatcggcgaggcagcccgcgtgctcccagagctgacgctggtgcaacccctgcgcagcggcatcgtcgtggactgggatgccgccgagctcatctggcgccacctgctggagcacgacctccgagtggccacccacgaccacccgctgctgttctccgacccacccttcagcccggccaccaaccgcgagaagctagtggaggtggccttcgagtcgctgcgctccccagccatgtacgtggcatcgcagtcggtgctgtctgtctacgcccacggtcgtgtcagcgggctggtggtggacacgggacacggggtcacctacacagtgcccgtcttccagggctacaacctgctccacgccacggagcgtctggacctggcgggcaacaacctgaccgccttcctggcggagatgctgctccaggccggcctgcccctgggacagcaggacctggacctagtggagaacattaagcaccactattgctacgtggcctccgacttccagaaggagcaggcccggccggagcaggagtacaagcggactctgaagctgcccgatgggcgcacggtcaccctgggcaaggagctgttccagtgtccggagctgctgttcaaccccccagaggtcccggggctgtcacccgtcggcctctccaccatggccaagcagagtctccgcaagttgtcactggagatgcgcgcggacttggcccaaaacgtgcttctctgcggtgggtcctcgctcttcaccggcttcgagggtcgcttccgggcagagctgctgcgcgctctgccagccgagacccacgtggtggtggctgcccagcccaccaggaatttctccgtatggatcgggggctccatcctggcctccctgcgcgccttccagtcctgctgggtcctgcgggagcagtacgaggaacagggtccctatatcgtgtaccgcaaatgctactgaccagggcagagctggggagggcgtgggggcagtaaagcctctgctacaaaaaaaaaaaaaaaa

SEQ ID NO: 28100 - DNA, 2346 bp, Homo sapiens
aaaatgcagggcgcagcagccgctgcagtggagccggtaggcctggccggcgggctgaaaggaagtgcgagctgtccgcccagggccgggtatccgcccctgcaggctgtggaggggatgtcaggagactggctggcctcttttcttggcccccgactccttccagtctgacactgaagactttataagcttccccccgaccaccctccacgggctccactctccacgggcctgggcttgcgccgcttcgagatcagcctgggggtcgcgccctcctggtcttgtccacgaagcgccgttcttgggccgttaggagctgctgggaagggctctgataggcccactcctcttctccacccaggagatgagaaggagggcaggcctttttaatctgatcagaatgttaacccatctctccgccttgcggtagaacccctggatacattatttgccctctcgaaaggcaggctctgaatttgattcaggtatatttcttcatagctaaccagcacaatggaaaactcagggaaagcaaataaaaaggatacacatgacgggccaccaaaagaaattaaactgcctaccagtgaagcacttctagactatcaatgtcaaataaaggaagatgccgtggagcaattcatgtttcaaataaagacacttaggaaaaagaaccaaaaatatcatgaaagaaatagccgcttaaaagaagaacagatttggcacatacggcatctactaaaggaactgagtgaagagaaggcagagggattgccagttgtaacaagagaggatgttgaagaagcgatgaaggaaaaatggaagtttgaaagagaccaggaaaaaaacttgagagatatgcgcatgcaaataagtaatgctgagaaactatttcttgagaaactcagtgaaaaggaatattgggaggagtacaagaatgtagggagtgaacgacatgctaaactcattacctccttacaaaatgacatcaacacagttaaagagaatgcagagaaaatgtcagaacactataaaatcactctggaagatactagaaagaaaataatcaaggaaactttgttgcaactggaccaaaagaaggaatgggccacacagaatgctgtaaagctcattgacaagggcagttatctagagatctgggagaatgactggctcaaaaaagaggttgcaattcacaggaaggaagttgaagaattaaaaaatgctattcatgaactggaagcagaaaatttggtgcttattgatcaactatccaactgtagacttgtggatctcaagatacccaggtatccagtgctacattcctgtcccacctctaatcctcgtcatctgctgctgctgcctttggaatcatgtctaatctctgccaggcgttgctggcgactatatcttacccaagctgctggactagaagtgccacctgaagaaatgtctttggaattgccagaaacacatatagaagagaagtcagaattgcaacccacagaagtagaaagtagagacttgatgtcctcatcagatgagagcactatcttacatcttagtcatgaaaatagcatcgaagatctccagtatgtgaagatagataaagaggaaaactcaggcacagagtttggggacactgatatgaagtacttactatatgaggatgagaaggatttcaaggattatgtaaacttgggccccctgggagtgaagcttatgagtgtggagagcaagaaaatgcccattcattttcaagagaaggaaattccagtcaaactctataaagatgtcaggagcccagaaagccacatcacatataagatgatgaagtcttttctctaagacggaaagctgcaaaggaaacacaacttttccttataaatgttctttgggaactgaagtatatccgttgcccattttacttacactttggctcatttttaaaccagctgttatttctaaaggtcatatttacatttaaaatcaaaggtattcagctattcatttacttgcatggtatgagtgaccaaaacggaagcacgctttgtatttctacactgaagtattcagaagcatgacagtgggttcaaggtagtctctgaggttccttttcacacacaaaaaattcactgattaatctgtgattccagtatgaaatagttccattagaaatgtttctaagaaaaacttagaagtttgcatagcattgtctacacatctttccctctgaggatgctcaatgtgatagacagccagtctataatgcaagccaattctccgtagtttaaccctgtgtattagtctgttctcatgctgctaataaagacataattgaaactg

SEQ ID NO: 28101 - DNA, 1415 bp, Homo sapiens
tgaccacaggagagccctagggggaggccggctccaccagcagccccatacatggcactcccagggtaccccctgggcaacgtggatgacagcaggtctaaggacagcccagcaggagagccccaaggtcaggtcccactcacagcagatgtcttggcagtgagcagctctgtcgcatccactgactggcaggatatagatcaggcctccttcaagacggccacccccagggccatatcaacatctggagacaaagacaagagtgcagttgttccagaacacggccagaagacacccagaaaaatcacacctctgcttcccagccaaaatccaagtcccctgcaagtgtctatgagccttcagaatccagcgtgggacaggcaggttcaagacgcaaggacaagtcagagtctagtggttttcccaagtcacctcctgggtaaagacaagatgtcacaaatggcgagtgttcctgagagagagccggagtcagccccctctgccccgagtgctgagctacagtccacccagcacatggaggctcagcccgtcgagagtgatgctgaccatgtcacagcaggtgccaatggccagcatggccctcaggctgccagcaccaccaagtctgctgaggagaaagctgagcatccaaaggccccacaccctgaagctgaagctttaccatctgatgagtccccagtggcaatgggggcaaatgtggtggacagcttaggagacctgcagacttggttcttccctccacctccagcaggcagtgtgtccccgtcgcctggcccccacgaggtggccctggggagaaggcccctggaccccagcctgtacacggccagtgaggagaacagctacatgcgctccatgaccagcctgctggacaggggcgagggctccatcagctccctggcagacatcctggtgtggtccgagaccaccatgggcatggccatagccacaggcttcctggattccggccacagcactgtggcagacctgctgcacagctcggggcccagcttgcgctcggtccccagcctggtgggaagcgtcagctcggccttctcctctgggctggtgtcagggaccagctcagccctgcgcaccatcacccgtgtgctggagacagtggagcagaggaccgtggagggcatccgctcagccatgcgctacctgaccagccacctcaccccacgccaggcccaggctgaccccaactatgattagagccctgcacagggacccccgaagggctggttcagtggcctccagagatccctgggaccctcacgccctgctcccttgcccattcttgctctggacggttcccccagcccatgcaataaatcaccagtgagcatttatttctaaaaaaaaaaaaaaaaaaaaaaaaaaaaaaaaaa

SEQ ID NO: 28102 - DNA, 1745 bp, Homo sapiens
ggtgaaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaagataaagaaaataaacatgaaaaaaatgcataatggattggacaagaaaaataagcgattgaacactagttttttatggtcatgttaatattattcctttgatcagaatgctactattatgttatcaaaggatggttgacacagtatcatctttagatttttctaaactgcagagctttttctgttctatcttaaccctattccttcccctgaggacataccagagtgtcagaaagaaagaatgagaactaacagttatacccttaaaaagcttcacagtttatgcccaaacagcagcctgtttgataataactgctttaaaggatagtatattccaaaatatttatgaagtagcatatatttaatacccttttcttttagtttttcctccaaaaagctgaaatctccaaatatttcaaaagtaaaaagtagaaaatatgtttgattacatttttcttttagtttttccaaacatgagagaatatactccaaaagtataactgtagctaaaatatacaatgcttagaggaatatggtaggagataaatttggataataagtaaatagcatattatgttgttttttaattattatactttaagttctggggtacctgtgcagaacgtgcaggtttgttacataggtatatacatgccatggtggtttgctgcacccatgaacccatcatctacattagatatttctcctaagctattcctcccctagccctgaccccctgacaggccccagtgtgtgatgttcttctccctgtgtccatgtgttctcattgttcaactcccacttatgagtgagaacatgcagtgtttggttttctgttcttgtgatagtttgctgagaatgatggtttgcagcttcatccatgtccctgaaaaggaaatgaactcatccttttttatggctgcatagtattccatggtgtatatgtgccacactttctttatccagtctatcattgatgggcgtttgggttggttccaagtatttgctattgtgaacagtgctgcaataaacatatgtttgcaggtgaaaaaaaaaaaaaaaa

SEQ ID NO: 28103 - DNA, 1113 bp, Homo sapiens
ggccgcctcctggggcagaatggaacagcctgggcccagggctccggatccctctctctgccaccacaacctccagccaacagatgaccccaactgggattcctatgctaccactatgaggactgcattcacgcctaaaacaggagcagtgcctgccttaattcgccaaaacggtatcagaagattaggatatacatattcacttagtgatcctattctcaatcagacacaatatagtgatgagtacacttggaaatcacactctaaagaagatttgatcaaaactgagacttcaagaggaatcaagagccacaaatctcatctcaatgaagacattttcctgtggacactacctcactgtcaacaaacggggacactaaagaactgcctcccttggaaaatcccggcttcaatgaaagaagttaacaaggcactatcaaatcagtttatttcccttactaagagagactttgtggacagatcaaaagctcagaagattaagaaaagttctcacttgtctctggaatggaaaaagttacttccccaacctccagacactgaattccgaaggaattaccaaattccagctaaaattcctgagcttcaagatttcagtttcaaatatggatgctactcaagcttgcctgttgcttctcagggtctagtgccttctgtgctgcacagctacctgaggaaccaagagcacacaaagaaacagaccacataccaaagtgactacgacaaaacctacccagatttcttaatgcttttaaactcatttacttcctctcaagtcaaagagtaccttcagagtctttcctacaaagatagacaaattattgatcgctttattcgtactcactgtgacactaacaaaaagaagaaatgaaaagggaaaatagtacaaatgaagaaaatctgaaaatcaatggaagcacgaggacattcctagtcattttctcaattatcaaggaaaaataagatgcaaatagcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28104 - DNA, 2018 bp, Homo sapiens
agctcccattggggtcggcgaacctggtgccaccccttagacaaagtcccagtctcccagaggcttttaccagctggccccattccttctgctgctgggtataataaggtcctctcaacgctgaagtgcctgtgaaacacagcccagaggagttctcattggtcctatgggctttgtcttcctctctgccccacccagataatcgctgctgcccctccactcccaagatgcagctgtgattctccatccccacacatccctcatcaatggttgactgcaaagaagtgagaagccaagcttagattaatgctcatgcctgaacaccctgagagcctggtgctggagggctgggtatccccttggcctgccaccagcacctgcacccacaccaggctggagccacgctctgcgcacagaaggtggccttgatttctcaggcacagctgacctcagagatactggtcctgactctgccaggtctcttatccctagtcttgttgccccagttccttctggattcaaggcgatgttgcctcaaaacaaggaccaggtgctgccacagacctcagtgctccctgggcgccccacttggggcttctcacaacttgtggactcctctcctcacaacctacagcctctctctccccatcagggcctccctccctctcaaccaccgttctcttccactcagtcccgtcgtccctcctcccctccaccagcatccccctctcctggcttccaattcggctcttgtgactcaaattctgactttgctccacatccctattctccctctctcccaagttcccctactttctttcaccagaactacctctctctcccccgtccacgtgcatcctctccctccaaccactggctgtacccctctccccctctgaccccttccttttctccctcccagcctcagaactcctcccttccccactcaccttgccagtccccttcccaccccgaggaactgcatagctccacactcacttccccaggccccagcccaccttctcataggctccactctaacaggcagacatggcgctggcatcagtacagggacactgggtccgggtcccctggagtggtggagggatgcgtgccaagcgagaaggatcctgcacagttcagggacccaggggccctggcccaggccctggtggtccagctggggcaccgccgcatcgcacacgacctgcggctactgcttttgcagcacctgtggctaggcagaaccggccaggccccagtcgtggagtatcctatatgcctggtgtgcctccggccccgcagcccctcctgccccctccccaggtacaggactggaccccggctgcttgctttccctcaactactgccctgtgtgcagggccaggaatctgggccactccggataggcatcggcttcggcctccgcctgcctcagggccaggccagggccttgcatctgctgcccgagaaaaggccgaaggaagcagggcctcagggcaaggctactcaggcctgtgggcatcaattgccagcatctcagcctccagcagctcaggcccgggccgacccagtcccaggcacaccctcccagaccaggagcttcaggtctgcaggccttcaatcaccaaactccccacgatgtttctccgggcctccacctcgggcaccaaaacaggtcactacctccctgaagcccaggccttgccctggcccaaagaggccagtttctctggagctcattctccaaaagtcatcagtctagttccagggccacggaggccccctggaacaccccctccaaacccaaccctcccaaccaggcaccagatctcggggagtccccgagacaccctgaggggctggctggccggaggtcaggtgtgttctcctgctctgaaccctgggagccccttgtggagtctgctgtctccaggctgaagaggaccaagggcaccaaggccccattcagccctccgtgtatctaataaagtctgacccaaaaaaaaaaaaaaaaa

SEQ ID NO: 28105 - DNA, 1061 bp, Homo sapiens
gggactgactccagcctctgctccgggaggccctcccgggctgcctgacctcccgggaccatgcagaaggcctcccacaaaaacaaaaaagaaagaggagtcagcaacaaggtcaaaacatctgtacacaacttgagcaaaacacagcagaccaaactcactgtgggtagcctgggattaggcctcatcatcatccagcatggaccctacctccagatcacccacctcatcaggaagggggctgcagccaacgacgggaaactccagccaggctgtacaggaagcatggctggggaggcctcaggaaacttacaatcatggcagaaggtgaagaggaaggaggtgatgttctgattagtgttggccatgccaatgtgttaggatatactcttcgagaatttttacagcttttgcaacatatcactattggaacagtgctacaaatcaaggtttaccgagattttattaacattcctgaagaatggcaagaaatatatgatttaatccctgaggccaaattcccagtaacaagcacaccaaagaaaattgagctggcaaaagatgaatctttcacaagcagtgatgataatgaaaatgtagatttagataaaagacttcaatattatagatatccgtggtcaactgtgcatcaccctgcaaggagaccaatatccatctccagagactggcatggatataagaagaagaaccatactattagtgtaggaaaagacattaattgtgacgtgatgattcacagagacgacaagaaagaagtgagggccccttctccatactggataatggtgaagcaagacaatgaaagctcttcctcctctacctcctctacctcagatgcattttggctggaagattgtgcccaagttgaagagggtaaagcccaactggtatcaaaggttggttagcaaatctgtggtcatatgagcatttatcttgcagacacccaagttttgtgcctcaccaggcacaagtttgctgtacttatcaaggactgtctgtagactcacaaaaaaaaaaaaaaaaaaaaaaaaaaaaaaaaa

SEQ ID NO: 28106 - DNA, 1161 bp, Homo sapiens
actgcagcaggagtttcaagaacagcagcacaaaaataatgacttaactggatagaaaaaaaggcacatattttcaggaaggcctctttattcttagaagttacccttcaagatgacaagtggtgcaaactcttcaggatcttacctgccctcagaaataagaagttctaaaatagatgacaactacttgaaggaattgaatgaggacttaaagctaaggaagcaggaactgctagagatgctcaaacctctagaagataaaaacaacctcttatttcaaaagttaatgtctaacttggaggaaaaacaaaggagtcttcagatcatgagacagatcatggcagggaaggggtgtgaggaatcctcggtcatggagctccttaaggaagcagaggagatgaaacagaacttggaaaggaaaaacaagatgcttcggaaggaaatggagatgctatggaacaagacattcgaggcagaagaacttagtgatcaacaaaaagcaccacagacaaaaaacaaggcagacttgcaggatggaaaggaaaagcaacagaggaaaatggaatgggtcaagtatcaggaacaaaataacatccttcagaatgattttcatggcaaagtgattgagctgagaattgaagccttgaagaactaccagaaggccaatgacctgaaattatcactgtatttgcagcagaattttgagccaatgcaagcatttttaaatcttcctgggtcccaaggaattagaattgtttaatcttattaatcttgctggaatagactctgctacttcaaagcagaaggccaaggagacagacatctgacaaagcatttccttgagctcttctgagaaaaacctgaacgttggatgtactatgggcattacaactatggacagagtgactactggcagaaatgaacaccatgtgagaattctgggaacaaagatctacacagaacaacaaggaactaaaggaagtcagcttgataatacaggagggagactctttttttctgaggtcattgccagatgaagcactgaagaattagcaggctttcgctccatttgctttggacagatttaaagactaggcacagccatttgtgttaattaaaatctctcgcaccttgaaaaaaaaaaaaaaaaaaaaaaaaaaa

SEQ ID NO: 28107 - DNA, 1130 bp, Homo sapiens
agtgaggcgtcgtccgtactggaggctagctcttgtcgcggccgcggcgagttaacatcgtttttccaatctgtccgcggctgccaccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaaaaaaaaaaaaaaaaaaaaaaaaaaa

SEQ ID NO: 28108 - DNA, 1945 bp, Homo sapiens
acttttggtcgagcggagggcgcgcagctccaccgttgccaagacgccgcgtaaacacccgagcgcgcgcagccaggtgcgctccttggggctgctggctgctgcgtttgcggcgggaggtggtggccgcggtcccacgagaaggggtatttttcgtcagccaagatgggttccaaaaggagaaatttgagctgtagtgaaaggcatcagaaattagtagatgaaaactactgcaaaaaattacatgtccaagctctaaaaaacgtcaacagtcaaatcaggaatcaaatggtgcagaatgaaaatgataaccgtgttcagcgcaagcaatttctcagattattacaaaatgaacaatttgagttggatatggaagaggccattcaaaaggcagaagaaaacaagagattgaaagaactccagctcaaacaagaagaaaaactggctatggaattggcaaaactgaaacatgaaagtctaaaggacgaaaagatgaggcaacaagtaagagaaaacagcattgagcttagagaattggagaagaaattaaaagcagcttacatgaataaagaaagggcagctcagattgctgaaaaggatgccattaaatatgaacaaatgaaacgtgatgctgaaatagccaaaaccatgatggaagaacacaagagaataataaaggaagagaatgctgcagaagacaaacgaaacaaagcgaaagcacagtactatcttgacttagagaaacaacttgaagaacaagaaaaaaaaaagcaggaagcttatgagcagctgctaaaagagaaactcatgattgatgaaattgttaggaagatctatgaagaagatcagttggaaaaacaacaaaagttagaaaaaatgaatgcaatgcgaaggtatatagaagagtttcagaaagagcaggctctctggagaaaaaagaaacgtgaggagatggaagaagaaaacagaaaaatcatagagtttgctaacatgcagcagcaaagagaagaagatcggatggcaaaagttcaagaaaatgaggagaaaaggctacagcttcagaatgcgttgacacagaaattagaagaaatgctgcggcaacgtgaagatttggaacaagtgcgacaagaattataccaggaagaacaagctgaaatatataagagcaagctaaaagaagaagcagaaaagaaattgagaaagcaaaaagagatgaagcaagattttgaagaacaaatggccttgaaggaattagtgctacaggctgcaaaagaggaagaggagaactttagaaaaactatgctagctaaatttgctgaggatgatcgaatagaattaatgaatgctcagaaacaaagaatgaagcagctggaacacaggagggctgtggaaaaacttattgaagagcgtcgccaacaattccttgcagacaaacaacgtgaactagaagagtggcagttgcagcaaaggcggcaaggatttattaatgcaattattgaagaagaaaggctaaaacttcttaaagagcatgctacaaacttactaggctatctccctaaaggagtatttaaaaaagaggatgatattgatctgcttggtgaagagttcaggaaagtatatcaacaaaggagtgaaatttgtgaagagaaatgatatcatcaaaattgggtaaagcatagattttttgtatgttaccactagatgtcagcataacttttgttttacagctcagtggcattaggtatccattgtctgtttggattttgtaaatcatcactgaatttcataacttgtaaacaattatcagatacaaattaattttaatcaagctgttatttttgtactgataatttcaaaatccgatttctacaacactacagagcactgtttgcatccccatcctcaagacagtatatttaccttgactaatacagaactctacccc

SEQ ID NO: 28109 - DNA, 1172 bp, Homo sapiens
agtccagcactaaaggatccccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtgggaggacaacgtgaaacacgggaaaggaacacaggtctggaagaagaaaggagccatctatgagggggactggaagtttgggaagcgagacggctacggcaccctcagccttcctgaccaacagacaggaaagtgcaggagagtctactcaggctggtggaaaggtgataagaaatcgggttatgggatccagtttttcggacccaaggagtattatgagggtgactggtgtggcagccagcgcagcgggtggggccgcatgtattacagcaacggcgacatctacgagggacagtgggagaacgacaagcccaacggggagggcatgctgcgcctgaagaacgggaaccgctacgagggctgctgggagagaggcatgaagaacggggcggggcgtttcttccatctggaccacggccagctgtttgaaggcttctgggtggacaatatggccaaatgcgggacgatgatcgactttggccgtgacgaggcccctgagcccactcagttccccattcctgaggtcaaaatcctagaccctgatggtgtgctggcggaggccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtggtataaaaaaaaaaaaaaaa

SEQ ID NO: 28110 - DNA, 1263 bp, Homo sapiens
ggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagtt

SEQ ID NO: 28111 - DNA, 2108 bp, Homo sapiens
atttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcgcccttcagaccaggactttattagatgatgagaacgacagtctgagatactcggcctttgttttgtttgggcaattggctgcctttgctgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgttttttttttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatcctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccaggtaactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgt

SEQ ID NO: 28112 - DNA, 1678 bp, Homo sapiens
aacgggaggcgcccgcggggctgtccgcggtcgcgccgggctccgcctgcagtgtggcccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgaggtaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttcaaaaaaaaaaaaaaaaaa

SEQ ID NO: 28113 - DNA, 3396 bp, Homo sapiens
cctctgactttgtaaacaaagccagagagccggaggaaatgaaattccaaatgccctctcctagcctggtttgacctccggtgttgatgcaaactcaagccggctctcactgtggcttgtggctccgggaaatggaacccagcttgggacagggaatggatttgacttgtccttttggcgtctccccagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaacagggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccagaaggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaa

SEQ ID NO: 28114 - DNA, 3499 bp, Homo sapiens
ggcgctggcccagggtcttctccaggctcacatgcttgctggaggctccaggcgggtggggagatctgcagggtccctttgttcccgtccggccaggacagtgtccagtggcacgagttgccatggggactgccatctgctgtgtggatacccatcggaggggcccagggtgagcgactgccccaaaggcccagcctgccctgagccctgaggccagctggtcggctttccctgccattatcccccgagccaggccggagtggggctcccagaggagctctcggctctaagtcccagcccctctcagaggaggcgtgcggccgaggttctgcagccagaggcttctcggctctgagctccggagccagatgtaacattgaccttaaatggtaaaagctccccagagtgaaaggaggctggccagaggaggaaaggagaataactcagttttagggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccagaaggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaa

SEQ ID NO: 28115 - DNA, 762 bp, Homo sapiens
caggcagcctcagcacaagaaaagaacatggtctagactgaagtaccaactaaatcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttagggactatccagatcctgtttggaattatgaccttttcttttggagttatcttccttttcaccttgttaaaaccatatccaaggtttccctttatatttctttcaggatatccattctggggctctgttttgttcattaattctggagccttcctaattgcagtgaaaagaaaaaccacagaaactctgataatattgagccgaataatgaattttcttagtgccctgggagcaatagctggaatcattctcctcacatttggtttcatcctagatcaaaactacatttgtggttattctcaccaaaatagtcagtgtaaggctgttactgtcctgttcttgggaattttgattacattgatgactttcagcattattgaattattcatttctctgcctttctcaattttggggtgccactcagaggattgtgattgtgaacaatgttgttgactagcactgtgagaataaagatgtgttaaaataaaaaaaaaaaaaaaaaaaaaaaaaaaaaaaaaaaaaaaaa

SEQ ID NO: 28116 - DNA, 660 bp, Homo sapiens
ttggcaacaccattatgacatcacaacctatttccaatgagaccatcataatgctcccatcaaatgtcatcaacttctcccaagcagagaaacccgaacccaccaaccaggggcaggatagcctgaagaaacgtctacaggcaaaagtcaaagttattggggtgcatagcagcctggctggaagcattctgagtgctctgtctgccctggtgggtttcattctcctgtctgtcaacccggctgcattaaatcctgcctcattgcagtgtaagttggacgaaaaggatataccaaccagacttcttctttcttatgattatcattcaccttacaccatggactgccatagagccaaagccagtctggctggaactctgtctctgatgctggtttctactgtgttggagttctgcctagctgtgctcactgctgtgctgcagtggaaacagactgtctgacttccctggttactcatgtcctcaaagacgactcatgatgctggatatgaagaactattgacttcttgggaaaaaacggagaaatattaattggaaagttgatttttatgataatatggaaaacctaaccattataaaaaagcaaacttgagtttcctaaatgtaagcatttaaagtaatgcatatttgttttaaaaaatta

SEQ ID NO: 28117 - DNA, 2446 bp, Homo sapiens
ctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccaaaaaaa

SEQ ID NO: 28118 - DNA, 2535 bp, Homo sapiens
acccttcccccttctccaaccgccaacggccgcctgcgcctgaggcccggcccacgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggagggcagagcagggcaggggagggcacagcaggccctgcgaagggcagagcggggcaggggagggcagagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcttcaa

SEQ ID NO: 28119 - DNA, 1955 bp, Homo sapiens
agaggggcgggacttctccgggtcaaggccaggtctcttccctgctcggtgctatgttcctgttccacggggtggcgggtcctggaagggagaagcccagacccagtggacactgacattgtctctcgctgttcccagccttttccaggcgtgtgacttaatccgtttccacagccagaccttttctccgtgagttcctcagccaggactgctgccatgccggtgactgttacccacccaaccgtcacgaccaccatgcggtcccccaccgtcgtagggtcctctagggccctgatccagcccctgggcctcctccgcctgctgcagctggtgtccacctgcgtggccttgtcactggtggccagcgtgggcgcctggaaggggcctatgggtaactggtccatgttcacctagtgtttctgctttgccatgaccctggtcatcctcctcgtggagctgggcggctcccaggcccgcttccccttgttttggcgcaacttccccatcacctttgcctgctatgcggccctcttgtgcctctcggcctccatcatctaccccaccacctacttgcagttcctgtcccacggccgttcccgcgaccacgccatcgccgccatcgtcttctctggcatcgcctgtgtggcttatgccaccgaagtaacctggactcgggcccggcccggcgagatcactgactacatggcctccgagctggggctgctgaaggtgctggagaccttcgtggcctgcctcatcttcgtgttcatcaatagcccctacgtgtaccacaaccggccggccctggagtggtgcgtggcggtgtacgccctctgcttcgtcctggcggccctcactgtcctgctgagcctggggcactgcaccaacatgctgcccatccgcttccccagtttcctgttggggctggccttgctgtccgtcctcctctatgccactgcccttgtcctctggcccctctaccagttcaacgagaagtatggtgtccagccctggcagacgagagatgtgagctgcagcgacagaaacccctaccttgtgtgtatctgggaccgccgactggctgtgaccaacctgacggccgtcaacttgctggcctatgtgggcgacctggtgtactctgcccacctggtttttgtcaaggtctaagactcccaaagggccccgtttgcctctccaacctcttcatcctgccccccctgagttttctttattgagtattcatttcctgtgttttcctcttccctatctcccctcctccccttttctttccttcccaattcatcgcactttcccagttctctgatgtatgttcttccctttcctctgctgtttccttcttgttttgttctgttgcccacaacctgttttcacccgtttctctttttccactctctcttttgtttctttcctctcaattcttttctaggtttcctgttggttttcttatctgcctatttcccgaccatcttctcctatttcctggggagccctgaggcttttcttctcctgcccccacgcacctccagcggtgatgagctccacacccccacacccattgcagctgtggcgccacgtcctcccaaggggccttctgcccgcccccgccctagccctagctgtgccttagtcagtgtgtacttgtgtgtgtttgggggagtgggaattgggccccctttctcccagtggaggaaggtgtgctgtgcacctcccctttaaattaaaaaaaatgtatgtatctctggaggtcaataatttccagtgagcgggaggcttcaagcgcagaccctgggtccctagacctcgcctagcactctgccttgccagagattggctccagaatttgtgccagacttacagaaaacccactgcctagaggccatcttaaaggaagcaatggatggatccctttcatcccaactgttcttcgcggtatc

SEQ ID NO: 28120 - DNA, 3072 bp, Homo sapiens
ggccgttggctggcgggtgcggcgcagcctcggtgtctctgggccggcggcagtgggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcacatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacagcatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgttttkgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccgctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagagcctgcacagtgaggtccgtgggctgctggacaccctggtgactgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28121 - DNA, 803 bp, Homo sapiens
gggggcttccgcgttccctgcacaaaatgccgggcgaagccacagaaaccgtccctgctacagagcaggagttgccgcagtcccaggctgagacagggtctggaacagcatctgatagtggtgaatcagtaccagggattgaagaacaggattccacccagaccaccacacaaaaagcctggctggtggcagcagctgaaattgatgaagaaccagtcggtaaagcaaaacagagtcggagtgaaaagagggcacggaaggctatgtccaaactgggtcttctacaggttacaggagttactagagtcactatctggaaatctaagaatatcctctttgtcatcacaaaactggacgtctacaagagccctgcttcggatgcctacatagtttttggggaagccaagatccaagatttatctcagcaagcacaactagcagctgcggagaaattcagagttcaaggtgaagctgtcggaaacattcaagaaaacacacagactccaactgtacaagaggagagtgaagaggaagaggtcgatgaaacaggtgtagaagttaaagacgtgaaattggtcatgtcacaagcaaatgtgtcgagagcaaaggcagtccgagctctgaagaacaacagtaatgatattgtaaatgcgattatggaattaacagtgtaaccatctgaaagcaactttttttggtgtctcaaaggagtaactgcagcttggtttgaaatttgtactgtttctatcataaataaagttatgacttcttgctagaaaaaaaaaaaaaaaaaaaaaaaaaaa

SEQ ID NO: 28122 - DNA, 2374 bp, Homo sapiens
gggatgtgtccggggaggcgcgggccggggtcgcgcacctcccggagccttgtggggtgtgctgcctccgaaaagtttgcctcgtctccacaagtctgtctccttttttgtcaacctcaagtacttttcttttggcaggtacttggatgcattttacaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaagggtgatgggattttataccaacaactgtttcatcttaaaaatatgtatatttttatattaaaaattgtacagtatgtcatctacccaaaaaaaaaaaaaaaa

SEQ ID NO: 28123 - DNA, 1597 bp, Homo sapiens
atggcttcttcctctctcatggatcattctttctgggagaagtttacccaccaagtcctgaagacattgaagcaaccctatggaaagatccatgcgtgccccaaatatgacagtcatggcagtgtgcacattttggacactgttctgtcttcctgcgtgggaatactgcggtcctcctttcaggcagctgtgaatgacaaacggtcgctggctgccgcaggcgccgttgccgaccaaacgcccaggttcacccaacgccagaggctcgtcctcaattcccgcgaggcccccggaggtgctggggtccctgcagggccgggccacctgccgtggagctcaggccgcgccagaatcggatccgggaagctgcgcgccatgagcagctccctgcggccgggccccagccgctggcggcgggcggccagcatcgtcctggcggctggctggtcgcgcccggagaccgccaccccgccgtcgcgcccgccgccggccgagggcttccggctgctgctgctgcagcgctccccgcaccaaggcttcatgccgggcgcgcacgtcttctccggcggagtgctggatgcggccgaccgctcggcggactggctgggcctcttcgcgccgcaccacgggccgccgcgcttcggcctgggcccggcgccattcagccgcaccgctttcccgtcgctgcccgacaccgatgaccacaagaccgacaacactgggacgctgcctgaggacgtagccttccgcatctgcgccgtgcgggaggcctttgaggaggcgggcgtgctgctgctgcggcccaggacttccccaccaggcccagcacccgggcctggcctcgccctggagccaccgccgggcctggcctcctggcgcgaccgcgtgcgccaggacccgcgccacttcctgcggctgtgcgcccacctcgactgcacacccgacatctgggcgctgcacaactggagcgcctggctcacccctttcttgcggggcaccactcgccgctttgacacggccttcttcctgtgctgcctgcgcgagccgccgcccgtctaccccgacttggcggaggtggtgggctaccagtggtcatctccatcagaggcaactgaaagtttcttatcaaaagaaatttggttgccacccccacagttctacgaagtgagaagacttgcaaactttgcctctctctctgacttgcacaaattttgtttgggtcgtgcattagaaggactggaaaggtggctgccgatcatcttgttaactgctgatgggatggtccatcttttaccaggtgatgagctatatttagaagattcagactttttggaaaatcttatgtctactgaaaaaaagactgaggaaatcatgaaggaaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgc

SEQ ID NO: 28124 - DNA, 5383 bp, Homo sapiens
ctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaagaaggttgatgctgctgaattgcttcgtttatacttaaactatgaccttttagaagaagctgtggatttggtgtcagaatatgtggatgctgtattgggaaaaggacatcaatacttcggaattgagtttccactgtccgcaacagccccaatggtgtggcttccatactcctctattgatcagcttctccaagctctgggagagaacagtgccaacagtcacaacatcgcactgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaa

SEQ ID NO: 28125 - DNA, 5150 bp, Homo sapiens
agaactggtgctgctgttgtaaaagttcgaattcatgaaccattctataagaaagtggcagcagccttaatacgtctgcttgttttggagaatatatttcttataccatcccatgatatttatctcttagtaggaacatatattaaataccaagttgcaaaaatggttcaagggagagtgacagaggtgaaatttcccctggaacattatatactggaattgcaagaccatagagttgcacttaatgggtctcattctgagaaagtggctatactggatgacaaaacagccatggtgactgcctcacaactgggccagactaatcttgtctttgtccataaaaatgttcatatgcgatctgtgtctggactcccaaattgcaccatatatgttgtagagcctggatttttaggtttcactgtccaacctggaaaccgatggagtctagaggtgggacaggtatatgtcattacagtagacgtctttgataaaagcagcacaaaggtctatatttcagataatctcaggattacatacgactttcctaaggagtactttgaagagcaactaactaccgtgaatggatcttaccatatagtaaaagccctgaaggatggtgttgtggtaataaatgcatccctgacctccatcatttaccagaataaagatattcagcctataaaatttctaatcaaacaccaacaagaagtgaagatttattttcccatcatgcttacacccaaatttctggcatttcctcatcatcctatgggaatgttatatcgttataaagtacaggtagagggtggcagtggcaactttacctggacttcttctaatgaaacagtggtcatagtaaccacgaaaggagtggtgactgcaggtcaggtcagggggaatagtactgttttggcccgagatgtacaaaatccctttcgatatggagaaattaagatacatgtcctgaaactgaacaaaatggaactgttaccatttcatgctgatgtggagattggccagattatagaaatacccattgcaatgtatcacataaataaagagaccaaagaagccatggcattcacagactgctctcatttatccttggatctgaacatggataaacaaggagtctttactcttctcaaagaaggtattcaaagacctggaccaatgcattgttccagtacacatatcgcagctaaatctcttggccatactctggtaacagtaagtgtgaatgaatgtgacaagtacttggagagcagtgctacatttgctgcttatgaacccctaaaggctttaaatcctgtggaagtggcattggtgacatggcagtctgtgaaggaaatggtatttgaagggggtcctcgtccatggatcttggagccctcccgattttttttggaattgaatgcggagaagacagagaagattggaatagcacaagtgtggctgccatctaagagaaaacagaaccagtacatctaccggatccaatgcctggatttaggggaacaagttctcacattccgaattggaaatcatccaggtgtcctgaaccctagtccagctgtagaggttttgcaggttcgcttcatttgtgcccaccctgccagtatgtcagtaactccagtatacaaggtgccagctggtgcccagccatgtcctctgccacagcacaacaaatggctgattcctgtatcaagactgagggacacagtcctggaactagcagtgtttgatcaacataggagaaagtttgataatttcagttcactaatgctagaatggaaatcctccaatgaaacactagcccatttcgaagattataaatcagtggaaatggtagcaaaagatggtggcagtgggcagacccggttacatggtcatcagatccttaaagtacatcagataaaagggactgtactgattggagtcaattttgtgggctattcagagaagaaaagcccaaaagaaatttccaacttgcccagatctgtagatgtggaactgctcctggtagatgatgtaactgtagtgcctgagaatgccaccatctataaccaccctgatgtaaaggaaacatttagccttgtggaaggatctggttattttttagtcaacagcagtgagcagggtgttgtcaccatcacttacatggaagcagaaagctctgttgagttagttccattacatcctggattttttaccttggaggtctatgatctttgtttggctttcttgggtccagcaacagcccacctcagggtgtcagacatacaagagctggagcttgatctgattgataaggttgaaatagacaaaactgtgttagtgactgtgagggttcttggctcttccaaacgcccattccaaaataaatacttcagaaacatggaactcaaactgcagttggcttctgccattgtcaccctgacaccaatggagcaacaggacgaatactctgaaaattatattcttcgagctaccactattgggcaaaccacacttgtggctattgccaaggacaagatgggaagaaaatacacatcaactcctcggcacattgaagtgtttcctccattcagacttcttccagagaaaatgacactgattccaatgaatatgatgcaggtaatgtctgaaggtggcccccagccccaatccatcgttcacttctccatcagtaatcagaccgtggctgttgttaataggagggggcaagttacagggaagattgttggcacagctgtggttcatggcaccatccagacagtaaatgaagatactggcaaagtcattgtgttttctcaggatgaagtacagattgaagttgttcagctaagggctgttaggatccttgcagctgcaactcggctcatcacagctaccaagatgccagtttatgtcatgggagtaaccagtacccagacccccttctccttcagcaatgctaatcctgggctcacattccactggtctatgagcaaaagggatgtattggatctagtgcccaggcattcagaggtttttctacagctcccagtagagcataactttgccatggttgtccatacaaaagcagcaggcaggaccagtatcaaggtcactgttcactgcatgaacagttcctctgggcagtttgaggggaatttgttggaactctctgatgaagtacagatcctggtgtttgaaaaactccaactcttctatccagagtgccaaccagagcagattctgatgcctataaattctcagctcaaactccataccaacagggaaggagctgccttcgtgagttctcgtgttctcaagtgtttccctaattcatccgtcattgaggaggatggtgaagggctcctgaaagctggttccattgcaggtactgctgtattggaagtcacttctatagaaccttttggagtcaaccaaacaaccataactggggtccaggtagcaccggtgacatacctgcgagtgagcagccaacccaagctatacacagcccaaggaaggaccctgtcagcatttcccttgggcatgtctcttaccttcactgttcagttttataatagtatcggagagaaattccacacacacaatacccagctttatctggctctgaacagagatgacttgctgcatattggaccagggaataagaactatacttacatggcccaggctgtgaacagagggctgacacttgtggggctttgggaccggagacatccaggcatggcagattatattcctgttgctgtagagcatgccattgagccagacaccaagcttacctttgttggagatatcatctgcttcagtactcaccttgtcagccagcatggtgaacctgggatatggatgatttctgccaacaatattctacagacagacattgtcactggagtaggagtggccaggagtccggggactgcaatgatttttcatgacatcccaggagtagtgaaaacatatcgagaggtggtggtcaatgcatcatcaagattaatgctcagttatgacctcaagacttatctcaccaataccctcaattcaactgtattcaagctcttcatcaccactggcagaaatggtgtcaatcttaaaggattctgtaccccaaaccaggccttggccattacaaaagtacttcttccagcgaccctcatgctgtgccatgtacagttcagtaatactttgctagacattccagcaagtaaagtctttcaggtccattcagatttcagtatggagaaaggggtttatgtctgcataatcaaggttcgaccgcagtcagaggagctgctacaggccctcagtgtggctgacacctcagtctatgggtgggctacactggtcagtgaacgtagcaagaatggaatgcaacgaatcctcattcctttcatcccagccttttatattaaccagtcagaattggttcttagccacaaacaagatatcggggagataagagtactgggagtggacagagttcttaggaagctagaggtcatctccagctccccagttctagtggtcgctggccatagccactctcccctcactcctggcctggccatttactctgtaagagtggtcaacttcacttccttccagcaaatggcatcacctgttttcatcaatatttcctgtgtactcaccagtcaaagtgaggcagtggtagtgagggctatgaaagataagttgggtgcagatcactgtgaagattccgccatcctcaagcggttcactggctcttaccagatcctgctcttgaccctctttgcagtgctggcatcaacagcttccatcttcctagcatacagtgccttcctaaacaagatacaaacagttccagttgtgtatgtaccaactctaggaacaccacagccaggttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgcttcttaaaactggt

SEQ ID NO: 28126 - DNA, 6614 bp, Homo sapiens
ctgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtacaaaaaaaaaaaaaa

SEQ ID NO: 28127 - DNA, 3253 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttctttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaa

SEQ ID NO: 28128 - DNA, 3399 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttctttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaa

SEQ ID NO: 28129 - DNA, 3277 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttctttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaa

SEQ ID NO: 28130 - DNA, 3432 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttctttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaa

SEQ ID NO: 28131 - DNA, 7323 bp, Homo sapiens
gttcagacccctggcctcgggaagtccgccggctgcggggttgggggccaaccgttctgtgggcggagtcctctcgcaacatccgccaggtagcttcttagttgctgcccctagctctaggagctcctgagtgcacacgccgtacccgtcccttgtcgggaatcctgtcgcaggtttttaagcaacagtcctcaggagggccaagggagtctgacggtgatgtcttcccccaggctcattcccctgtggaaagatttaaaactcctcctaaatgacaccataaataaaagcaagcaaccttcggaagacccaaagaactgcctgattgtgctgagtgaccggtcccaggctgtagcatggatgaagagcaaaactgaggacatggttgagaaaagaacattctccatgactgaacgattgccacccatccagtccatggtccatgcaggctcctttcatatcctcgtggtctactgtggtgacctgatcctgcgactctttggggaccactttcgggcattcaaacccctgggtaaagtgccctgccgcttcaacatcagctgcctctgctatgacccggaaatgaagatgcttctgtctggcatcctgggggcagtggtgacctgggtcattgagctaggtggcacgggcctccaaatagcccacatggtctccatgccaggtgatgagcttgtccaggacatcgtgctgaatggtcccagtggctccctcctggccctgtgtgagacggtggtgagggtccttatgcaccagggcaagggccagctgggagaggtaaagaggttcacgtccaccagcagcggctcctccatcacctgctgcttcacctgttttgatcagggctttctctatgctggaaaccaagctggggaaatccaagtttggagcctccagcagggccatccactccacagtttccaggcccatcaatcaggagtgatctgtatccgcagccgaccagaggcccacaccctgctaacagctggtagtgacagcctaatcaaggagtggaacctgacttcagggagcctgcttcggcggctagagcttggtgaggagctataccggctccagtttattgacagcattactttcttctgccaaactgcccatagtttttccttgcaccgcctgccctgcttctacagcctcttcaatgtctgtggctctgctccccagcagttgcgtcgggtctgctgtggaaataactggttccggatcctgtgtaccactgaggatggcttgttgcgctttgtgtccccagtaacaggggaccttctggttatcacctggcccttctcaatcctggaccaggctgtggattgggcctacgacccaggtaaagaggagctctttgtagcaacaggcagctcagaggttctggtatttgacacaacccgctgcccttgcccagccaagtatctcttaggcacctcaccaaattctcaggactttgtacaatgcctggcttatgggcatttcaacttggggcggggtctagagggactgatattctctgggcaccagagtggtgtgataagagtgctctcccagcacagctgtgctcgattagaaaaattcatgcactttggcgctgtactggcactctccacgctgtctggagggatttttggtggccaaggaaactctctgctctgttcctatggaatggatgactatgtgcacctgtcagaagctgtgcttgatggggtcaaagtacaactgcggcctctcgccagcattctcagcagctgtcacctaacacatctgatactcttgcccaagtctgtgggtgccatcacagagacaaactgcctgcgtctctggaagttccatgattttctgtcctctgggtcacagaatggcttgaaattcatagaaacactgcctctgcacctgtgtgccatcacatcctttgatgtctgcctctccttgagtctttttgtcacaggttctgccgatggctctgttcggatctgggacttccatggcagactcataggcattctggactcatcactgcactttggcccagtctgttttgcaaatgaccggggtgacctgcttgtgacttttaaccagagtctttacctagtgtcctgtttaaaattgcttcccccagccctgctgactcgcctttcctttatgagcatatcagatgaagtactggaagtccctaagcctttcataccaagcttcttcttctcctttgagaccatgtttgtgcccaagtacatctaccctggacaagcgcaacagaaattagtgggtctggagaaacttgtcaacaaccgggccattgcctttgaccattctgtgccacatgtgatagaagaagatgaggaagggagcccagtgttactgcgttcctccatgcattattctttgcaggacatggaagattggatgcaggtgagcaaacgttaccaatgccattatgtgcttcctccccagctacaactgactagctgggatggactcaacccctatcagatattgcgatactactttggtcatgggcgggaatggctttttgcccctgactgctatatccccaattcagtgattcgtgcccgtctttggccagagggcaccccaatatacctacagtgcaacctgcatgcaccccagcgggagctggaatgggacaggtctcaagaattctttttctggcacagcagggtaagagctataagtaatacagaatatccaaagaataaggaggaggatgaacacttcctagaaatgagactttccaaggatgtaacctacagtgtccttacagatggagcaaaccgaagttggctgggaagaaagatgagtgaaataaccattaatagcatgattgagacaatgctcaatattatggtccatgcttccttgctgaagtaccagtgctgtgttggtgcactagggcaaatctttgcctcttaccaggtgtccccagccctacgctctgagacagcccgtcggctactgaatgatacaaccaattccaacccgctgatccgagaactagcttgggaagggctgaagcgtctaggaatgattactcatctttttgccatgcctctggctcaaggattaatggacaaggatgaaagagtgaggatcaagaccctaagcctcatggctgagattggaatccactctaggacctcactcttacagctgacccaaaaacaagagacttttcgggagatgcagcagcagatgatcggggaggaacccctggaccatctactggggatgcgggccacagatctccaaatcctttccactcaagtggagcagagattgaatgaaaacctgaccctgtcacatagagatgaaaagccggctttttctttagatgtctcaatgccttctgaacttaaatcctccctgaaacctcctacagtttctgaagaatctgaagtggccatcaagcccagcaaaggccaaagacgaggccaagcaggggtcaaaaagcatagccaaaaatggttgcggggtctcaagaagacgaaagagagagactctaaacagatgagcacagagccaggcctcttagaggatgaaagtgggactgaggccgcaccaattgagatggaggaagcatccgtctattcccaatggtcttcaagcaccagtgtaataaagctctcaaaagatgttgattctcaagagaaagatatctcgaaggatcacattgcattgaccctgaagaggctgcagaaaatacgtgacaaaagagacaagaaagcaacagctcagaaactcaaaaagaagcacaaaaagaagggaaaagaagccaaagttataaatgaggaaactacacctcctgtaatggaacagccagttactaaaaaggttaaaatccaagggcggggagcctctggaatatctggccgcaggtcaaccgctggagatggctcatcatggagggacgatctatgtcgtcttatggccctgaggatatctggttcccaaacaaaaatgtcagaaaacctaaacgctgagctagtgacatttgctcaggagatgctggtagataggcaccccagctgggaactctttcaggagatctgccccctattgaagaaagaaagtaaggttctgcttgaggaccttgattgggatgtagtcccgccagagaagaaaccaatttttatccaggaaggagcaattagagaggacatgatacaaggtgtgacccaagaggtgatcagacacaaggaagtgatgccaagggaagaagaacaagcacaaaagaaagcaagagacatgctgggcttggaggaaacccaagtgattttgaaaaagggcaagaaagttatttttttagaaccaggtaatgtaaccatgggaaaagaaatatcaaagaaagaagagaagaaaacctttcagaagtcacctaagcaagggaggaaagctgtccagaaggaaagaaaagtaggaaaaataaagagggaaatgaccaaagaagagagggatatgagtgaggaagtggaggaaatggccacactagaggagaaagtggtcaaacaagaaggaaaactggttatgattgagaggacaccatcttggcaggactggaaaaaggcctgggatgagtggaaacaggtccatggtgagacaaggaaatcctggaaggcatggaaggaagaatgggagaagaggcttcttcaggaagaggagaaactacatcaggctggagagaagctatccccggaggaggaaatgcttcaggaggacaagaagctgaaatgggaggagtggaaacaagtctgggaaaatatgttatcatctaagtccaaggagcaacagtacaaggatgaggaagaagtgactttggaggaagaagtgtctcgggagggggaagaaaaagaacagcagaaagtggaagaactgccccagagggaacaaaatctggactggcaagaaaaggagctggcccaggaattggaggaactggaatgggacatggaagaactgtcttggaaagaagaggaactgaatcaggaagaggggaaactggttgaggaaaagaagaaactggctgaggaagaggaggcattggcctggcaaagggagaaactgtctgaagaagagacaaaactggcccaggaagaagagttgctgatccaggaaaaggagaaactggcccagcacaaggaaaaaatgcctgaggaagaggaaagactgggacggaaaagggagcaattgattgagaagaagatgaaactggcccaaaaaagggaaagatggatcaacagcatggaagaactcacaaagaacaagatgatactgtaccagaagaagaatctggctcaggaaaagaagaatctggcccaggagaaggaaaaattggctcagaggaaagagaacctactctataataaagaaagactcacccacagcaaaaagcaattagtgcaagtaaagaacaaattgggaatgttcaacaagatactggctcaggtagaggagaagctgacacaggaaaaggagactgtgatcaagaagaaggagaaactggctgaaacagagaaaaaattggtccaagtagaggatagtttggccaaaaaacaggagaaattggcccaggaaaaaatgaaattagctctggagaaggcaatggtccaaggaaagaaacggctcagaggagagttggatattgctaaggaagaaaaggcattgaacctggaaatgaaaagactggctgaggagaagatgagactggttgagggaaaagaaacactgtctaagggagagactccagaaacttctagacaaaggaaaatgactcaagttgaacaagaactatttgagagaaaattgtcactagaggagaagatactgctacatgaagacaggatattggccatggaggaaagcgaaattgccaaaggaaaactggaatttactagaggacagagaatatttgtccaggggcaaagaaagttagccaaggcttcaaggaagttgattaaaaaaagggagagcctttccaaggaaccagcaaaactgaacaaaatcttaaaggcacttcaaaaactaaccagggatgaaaggaaactaacacaggaagaaataaaaatgacaaagatgaagagggcactctttgttaaggagcgcaggttgagtatagaacagagtaagctggatatcaaagagtgggatttttctgaaaaacgatcagaactgactaaagatgagaagaaactggctcggaagcagagaaaactggccaacaaaatgagaagaatgataaacaaagaagaaaaaatgactgaggaagagagcaaattggccagaaagcattcagaagtcatactggatgatgaagaggaaggaggaatagaagaagaagagggaaacttagaatggctgcatctggccaaacatgaagccattgtgtaccgtcacagacaggccctggagtcacaagacacaaggatctcaagtagacagtccatgagtccaaaatacctgaaagtgattcctcctataaaagcaaaggaaaaggagagctggccaaaacctttggctgtccccacacaaaagtccccattagctaccaagaggattccagacccaagggctaaaaattggcatcttctaggagaaccttacagaagtgagagggcacagcagatatccattgctcacaaggagatggaaatgcaatacttttatcctgccaccagagacatttttccaagtgcccatgcctctgtggaaaaacaaaccctggcactgatgtttcaaaaggacttctgggattttaaggataaacgcaggtttcctaaactgcccaagttagagaagaagacacagcccatttctaaaaaaaaggaagagttgcctttgtgggagacatttgtggcactgtaccatgttttgcggatgctgcagcagcgatatccaaaagacagcactgcttggatggaacagttctaccagctcatggacctgtaccaacttaagtcccccagaatccagaagctgcttcaggagctgctaatgagagaggaacctcaaccccaagagatcatctacgaagaggccctaaaagccacagagctagttcccggggaacggctgttctgctgcctgttttgtggcagttctcatactcctagaagtcctcaggagttccagggtgcggtacccctcccatggcagaactgtgtgcgcaccatccttcccgtgggcattgcccggtatgggatcttagaacttgcctggaagagcctgcctgaagctgatcttcatctcaccaaggcactgacacacaccgttgctcccactctctaa

SEQ ID NO: 28132 - DNA, 1760 bp, Homo sapiens
gggggagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtatataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaaacctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcaaaaaaaaaaaaaaaaaaaaa

SEQ ID NO: 28133 - DNA, 1734 bp, Homo sapiens
ggagacagagatcccaggacaaatgtgcagcaggcccctgagcatgtgtagaaatgttgtcatcatttccacatagaaagacttggaggaaatcaaagaagacagtaaaagtcacaagatcctatccaaccttcccttccctgaatgcctgggaagaattcaggggcctcttgcctgtggatggagagccgaaccctggagcgggcctaggtgtggaggagggactgctctgccgggtggttcattctccagaattcaacctgtttcttgactccgtggtgtttgaaagcaacttcatccaggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagaggattctcccattgaggtttgtggagctccaggtatgtgaccactatcaacgcatcctgcagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgagtttcaggagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcgtcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaacaaaaaaaagaaatgttttcttccctgctcagaccattctggacaaatgtgaactgccagacaccttccatttccctttctatctgtttttcttgctagttcctgtcttctgattaaagcttcattccttcttaaaaaaaaaaaaaaaa

SEQ ID NO: 28134 - DNA, 983 bp, Homo sapiens
atttttaaaagcaacttctgagaagggcttagaacaaattttttcccggagtgccatttcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtgtgattataagctttactgtctgcgaccatctctcagaagtttggagaggaaagccatcagagccatagaagatgagaagcgagagcttgccaaactgagaagaacaacaaatagaattctggcttcctcctgctgtagcagtaacattttaggatcggtgaatgtatgcggttttgaacccgatcaagtcaaagttcgagtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccgtgcagcccgtgcaacccctgcaacccctgcagcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctgc

SEQ ID NO: 28135 - DNA, 3772 bp, Homo sapiens
gagccagactgcatccgccgcggcgtctccatggcacgaccctggcctccgacttcaacgacttcataaggcggcgtttctgggcgcagccgtgtcgctcctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgttgagatcactgtgtagaaggatccgcctgctttccgctgtgcttcactaaatccaaggaggagctgtgcattccagcaggtttagaggagatccagccctaagaaccctggggccggcgtctgggatctgttctggaacggaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggttttttctgacctaaaccagcaggaagtcgtcctgggctgtaagcaccatcacttgctttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttaaaaaaaaaaaaaaaaaaaaaaaaaaaaaaaaaaaaaaaaaaaaaaaaaaaaaaaaaaaaaaaaa

SEQ ID NO: 28136 - DNA, 2298 bp, Homo sapiens
cgagcggttctcacccgccctctccgcacgtccgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaaaaaaaaaaaaaa

SEQ ID NO: 28137 - DNA, 1331 bp, Homo sapiens
cctctccccaattctgtaagcccatgaggagagaggaaggcctttctctccatgctccttttgcgggaactccctggcaccaaggccaggggggaaaggacagtctctgatgaggatgggtctctaggctgctctgagtgctgtccctgcactgaagaagttatagttccctcccaggcggccccctccctgcccctcagctcagcctcaatcaagaagttccccatctttgaccactccaagtaggagaaaccggcccagggctcccttagagccgagaacagtgagctggccatgacggaggaggtatggatgggtacctggagaccccatcgcccccggggacccatcatggccctctacagcagccctggacccaagtacctgattccaccaacaacaggcttcatgaagcacacgcccaccaagctgcgtgcaccggcctacagcttccgtggggcccccatgctcctggcagagaactgctccccagggccccgttacaatgtaaaccccaagatactgaggactggcaaggaccttggccctgcctactccatcctggggcgctaccaaaccaagaccatgctgactcctggtccaggtgactactttccagagaaatccaccaagtacgtgttcgactcagcacccagccactccatctctgcccggacaaaggcattccgagtggacagcaccccaggccccgctgcgtacatgctgcccatggtaatggggcccaataccgtcggcaaggcctcccagccctccttttccatcaagggccgcagcaagctgggcggcttcagcgacgacctacacaagaccccaggtcccgcagcctaccgccaaactgatgtgcgggtgaccaagttcaaggctccgcagtacaccatggctgcccgtgtggagcccccaggggacaagaccctcaagccaggaccaggcgcccacagccctgagaaggtgaccctgaccaagccctgcgccccagttgtcaccttcggcatcaaacactctgattacatgactcccctgctggttgatgtggaataacgccagccctgctgtgccccatcacacccggcatctacacaagatccgccgggccacagagctcgaggctgtcttcaccagctgggctgggccagcctggccctgcagggcagagcacgcttgtttgggcaattgtaatcagttactttttttctatgctattttaccattttttaatcttgttttctgctgtgcccaaattattaataaatcagattgcattaaaaaaaaaaaaaaaaaaaaaaaaaaaaaaaaaaaaaaaaaaaaaaaaa

SEQ ID NO: 28138 - DNA, 1249 bp, Homo sapiens
gagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctccatggagtgggatacgcaggtggtgaaggggtcctcgccgctcggccccgcagggctgggggctgaggagccagccgccggcccgcagctgccgtcttggctgcagcctgagaggtgcgctgtgttccagtgcgcacagtgtcacgcagtgctcgccgactcggtgcacctcgcctgggacctgtcgcggtccctcggggccgtggtcttctccagagttacaaataacgtcgttttggaagcgcccttcctagttggcattgaaggttcactcaaaggcagtacttacaaccttttattctgtggttcttgtgggattcccgttggtttccatctgtattctacccatgctgccctggctgccttgagaggtcacttctgcctttccagtgacaaaatggtgtgctatctcttaaaaacaaaagccatagtaaatgcatcagagatggatattcaaaatgttcctctatcagaaaagattgcagagctgaaagagaagatagtgctaacgcacaatcgcttaaaatcactaatgaagattctgagtgaagtgactcctgaccagtccaagccagaaaactgatcctgtaccaaagcttgagtgtcaggttcaggctttattgctgtcttcaacaacaggtgctgcttagtcatttcttgaaaaagattggcttcaagaatggaggggaaatgcagtttctatttacctttaggctgattttccaaattatttgtgaagctgtttttagaagatgagagactaaggattcttctcttttatagctatttgccttaagaacttactttagattcttattgaattcataatacttatctctgaaaatgtctttgactgtaaatttaggaattaagatgcagagtcccatgtgtcctctgatctaaagttgcatggttggtctgaaaatagagttgggcttaatgttgacttctattactcctgcatggagcagttgttatgaatactaatacatcactttttaacttctgtaaaatacagatcataatattctataggtaatgtttaataaattgcctgaataatatacaaaaaaaaaaaaaaa

SEQ ID NO: 28139 - DNA, 957 bp, Homo sapiens
atggacaagataaaccagacatttgtgagagaattcattcttctgggactctctggttaccccaaacttgagatcattttctttgctctgattctagttatgtacgtagtgattctaattggcaatggtgttctgatcatagcaagcatcttggattctcgtcttcacatgcccatgtacttcttcctgggcaacctctctttcctggatatctgctatacaacctcctccattccctcaacactggtgagcttaatctcaaagaaaagaaacatttccttctctggatgtgcagtgcagatgttctttgggtttgcaatggggtcaacagaatgtttcctccttggcatgatggcatttgatcgttatgtggccatctgtaaccctctgagataccccatcatcatgaacaaggtggtgtatgtactgctgacttctgtatcatggctttctggtggaatcaattcaactgtgcaaacatcacttgccatgcgatggcctttctgtgggaacaatattattaatcatttcttatgcgagatcttagctgtcctaaaattagcttgttctgatatatctgtcaatattgttaccctagcagtgtcaaatattgctttcctagttcttcctctgctcgtgatttttttctcctatatgttcatcctctacaccatcttgcgaacgaactcggccacaggaagacacaaggcattttctacatgctcagctcacctgactgtggtgatcatattttatggtaccatcttctttatgtatgcaaaacctaagtcccaggacctccttgggaaagacaacttgcaagctacagaggggcttgtttccatgttttatggggttgtgacccccatgttaaaccccataatctatagcttgagaaataaagatgtaaaagctgctataaaatatttgctgagcaggaaagctattaaccagtaa

SEQ ID NO: 28140 - DNA, 951 bp, Homo sapiens
atgaagatagcaaacaacacagtagtgacagaatttatcctccttggtctgactcagtctcaagatattcagctcttggtctttgtgctgatcttaattttctaccttatcatcctccctggaaattttctcattattttcaccataaggtcagaccctgggctcacagcccccctctatttctttctgggcaacttggccttcctggatgcatcctactccttcattgtggctcccaggatgttggtggacttcttctctgagaagaaggtaatctcctacagaggctgcatcactcagctctttttcttgcacttccttggaggaggggagggattactccttgttgtgatggcctttgaccgctacatcgccatctgccggcctctgcactgttcaactgtcatgaaccctagagcctgctatgcaatgatgttggctctgtggcttgggggttttgtccactccattatccaggtggtcctcatcctccgcttgcctttttgtggcccaaaccagctggacaacttcttctgtgatgtccgacaggtcatcaagctggcttgcaccgacatgtttgtggtggagcttctgatggtcttcaacagtggcctgatgacactcctgtgctttctggggcttctggcttcctatgcagtcatcctctgccatgttcgtagggcagcttctgaagggaagaacaaggccatgtccatgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactga

SEQ ID NO: 28141 - DNA, 942 bp, Homo sapiens
atgctggctagaaacaactccttagtgactgaatttattcttgctggattaacagatcatccagagttccggcaacccctctttttcctgtttctagtgatctacattgtcaccatggtaggcaaccttggcttgatcactcttttcggtctaaattctcacctccacacaccaatgtactatttcctcttcaatctctccttcattgatctctgttactcctctgttttcactcccaaaatgctaatgaactttgtgtcaaaaaagaatattatctccaatgttgggtgcatgactcggctgtttttctttctctttttcgtcatctctgaatgttacatgttgacttcaatggcatatgatcgctatgtggccatctgtaatccattgctgtataaggtcaccatgtcccatcaggtctgttctatgctcacttttgctgcttacataatgggattggctggagccacggcccacaccgggtgcatgcttagactcaccttctgcagtgctaatatcatcaaccattacttgtgtgacatactccccctcctccagctttcctgcaccagcacctatgtcaacgaggtggttgttctcattgttgtgggtactaatatcacggtacccagttgtaccatcctcatttcttatgttttcattgtcactagcattcttcatatcaaatccactcaaggaagatcaaaagccttcagtacttgtagctctcatgtcattgctctgtctctgttttttgggtcagcggcattcatgtatattaaatattcttctggatctatggagcagggaaaagtttcttctgttttctacactaatgtggtgcccatgctcaatcccctcatctacagtttgaggaacaaggatgtcaaagttgcactgaggaaagctctgattaaaattcagaggagaaatatattctaa

SEQ ID NO: 28142 - DNA, 3138 bp, Homo sapiens
attcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcaaaaaaaaaaaaaaaaaa

SEQ ID NO: 28143 - DNA, 2109 bp, Homo sapiens
gattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatctcttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccatgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatgcagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtccttttccaggggtccaagggaacaggagaggtcactgggcctgttttctccctcctgaccctgcatctcccaccctgtgtatcatagggaactttcaccttaaaatctttctaagcaaagtgtgaataggatttttactccctttgtacagtattctgaggaacgcaaataaaagggcaacatgtttctgtt

SEQ ID NO: 28144 - DNA, 6980 bp, Homo sapiens
gtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagagtaagactgctgctgctgctgctgatgtgaatggatttaaacctttgtcaggcaatgagctgaagaacaatgggaactctactagcctgcctttgtctagaaaggttcttaagtcactcaatcctgcagtctatagaaatgtggaatatgaaatttggctgaagtctaaacaagctcagcaaaaacgtgattattccattgctgctggcttacaatatgaagttggagacaaatgtcaagttaggttggatcacaatggaaaatttttgaatgcagatgttcaaggaattcattctgagaatggaccagttttggttgaagaactgggaaagaagcacacatcaaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagagaaaatcatcacatgtaggtgatagaaaaggaagcaggcggagaatggatacagaagaacgaaaagacaaagactctattcatggacatagtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttctcagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttgaaaaaaaaaaaaaaaaaa

SEQ ID NO: 28145 - DNA, 3007 bp, Homo sapiens
ggctcgcactttaagacttcccgagcggcggcggggacgccagtcgagccgggagacgcttacctgccgcttccccgcgccgcccggtgcacctggccgcaagggacctcgttctcagggaagacggcgacattccgcggaggtggaaccgccgcgcgccgtccgggctcggaccttccccggaacgtgggggcgccttagcgactccttccctgttgtgcccccgttcccggcgttcagcccggccccgcaaaggtgggacggctcccggcttcagttacggaagcggcccgtgtccagcgacgagggttcgaaaatgccccgcgcgttcctggtgaagaagccgtgcgtctccacgtgcaagaggaactggagcgagctccccgacgaggagcgcggcgagatctacgtgccagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatggcgatgtttttaagagtgggatggagctggcttttctccattcccgtgcgcttctatttatcctggacatttcaaacctcctctgtgccttggctctgggcgggggctgccccaacccacccccgttctttgtacgtgctgagacagccactagaagatcttcctccagcggcgccctggacggctgctcctgcgaacagcccatggcatcttctgctcttccctcccggctctgccctgcacatcctgttgagccaagccccagtgacccggagagctggcctgatgctgagagtgtgtcctcctggggctttagggggcaggaaggtgggacgaatgacgatgcccatccactacctgaagcactaggacactcttgcagggccaggctggaagaccggcccttttcttggttgagtcaaaagccttagcacagtggcaaaaaatgggacagaatgatgaccagcacctcagaaacttccagagggaggagaggatttgatggctaccaaattgtatctgttgccttttttctgactttttcacctgaccaggctggggtttggagtggctgtggggagacccgtcctggctggctggctggctcccttgctcccttgctgcagctgggaaaggggttctgggtgtaaagaggtgtgcgtcttgtgggccaaagggaaaaacaggcaggggtcagagccagcctgccagaggcaaatgcaaaagaggtccccagaacacagccagctgggcagccccttaaagccaaaccccacctgaagcagaaccactttggcctcccctgcccaaaatgggtagtgtctacacgtccccgggctcaggctcaggcccagccctgggctgacctgagaggaaggctccttcctggactgccctctgaaatgtgtatagattgattctaaaatctcttgtttcacttgactttagagtgtctgggacgctgctgtattctgaaagtcacatagcacacagtaatgttatctggaagctctgtttttgtttacatttctgtatccctgggttgactgccaatccgaggccgtcatgaagctctgtgttgtctgttttattttataaccttcctctcaactattaaaattagagatctaaaaaaaaaaaaaaaa

SEQ ID NO: 28146 - DNA, 4869 bp, Homo sapiens
atgacgggttcccatttgtcccatgactcatggcagtatgttctgctgattccttctgttctacaagaaggctctttggataaagcttgtgcccagctttttaatctcactgaatctgttgttttgacggtctccctcaactatggtgaggtccagaccaaaatatttgaagaaaatgttactggagaaaatttcttcaaatgcatcagctttgaggttcctcaggccagatctgacccactggcatttattacattttctgctaaaggagccactctcaacctggaagagaggagatctgtggcaatcagatccagagagaatgtggtctttgtacagactgataaacccacctacaagcctggacagaaagatgtaaatggcatcgctcagtttttcttggacacatatacgtttacatacccaaatatcactttgaaagatcctcaaaacaatcggatttttcaatggcaaaatgtgacttctttccgaaatattacccaactctcgttccaactgatttcagaaccaatgtttggagattactggattgttgtgaaaagaaactcaaggaagacagtgacacaccaatttgctgttaaaagatatgtgctgcccaagtttgaagttacggtcaatgcaccacaaacagtaactatttcagatgatgaattccaagtggatgtatgtgctaagtacacctttggccaacctgtgcaagggaaaacccaaatccgggtgtgcagagagtatttttcttcaagcaattgtgagaaaaatgacaatgaaatatgtgagcaatttattgcacagttggaaaatggttgtgtttctcaaattgtaaatacaaaagtcttccaactctaccgttcgggattgttcatgacatttcatgtcgctgtaattgttacagaatttgggacaggaaattactgtatgcagatcagtgagaagacctcagtttttatcactcaattgcttggaactgtaaactttgagaacatggatactttctacagaagagggatttcttattttggaactcttaaattttcggatcccaataatgtacctatggtgaacaagttgttgcaactggagctcaatgatgaatttataggaaattatactacggacgagaatggcgaagctcaattttccattgacacttcagacatatttgatccagagttcaacctaaaagccacatatgttcgacctaagagctgctatcttcccagctggttgacgcctcagtacttggatgctcacttcttagtctcacgcttttactcccgaacgaacagcttcctgaagattgttccagaaccaaagcagcttgaatgtaatcaccagaaggttgttactgtgcattactccctaaacagtgaagcatatgaggatgattccaatgtaaagttcttctatttggtaagtctcagtcatgattcaggaaactttcagcatcgtatctcttcgtctcctatttacacagcctggaatggaaacttctcgttcccactcagcatcagtgctgatctggctcctgcagccgtcctgtttgtctacacccttcaccccagtggggaaattgtggctgacagtgtcagattccaggttgacaagtgctttaaacacaaggttaacataaagttctctaacgagcagggcttacctggttccaatgctagtctctatcttcaagcggcgcctgtcttattctgtgccctcggggctgtggatgggaacgtccttctactgaaatctgaacaacagctgtcagctgaaagtgtgtataacatggttccaagtatagagccgtatggttatttctaccatggcctcaatcttgatgatggcaaggaagacccttgcattcctcagagggatatgttctacaatggtttatattacacacctgtaagcaactatggggatggagatatctataatattgtcaggaacatgggtctcaaagtctttaccaatctccattaccgaaaaccagaagtatgtgtgatggagagaaggctgccactccctaagccgctttatctagaaacagaaaattatggtccaatgcatagtgttccgtctagaattgcatgtagaggggagaatgctgactatgtagaacaggctataattcaaacagtaagaacaaacttcccagagacatggatgtgggacctcgtcagtgtcgattcctcaggctctgccaatctttcgttcctcattcctgatacgataacccaatgggaggcaagtggcttttgtgtgaatggcgacgttggatttggcatttcctctacaaccactctagaagtctcccaacctttctttattgaaattgcctcacccttttcggttgttcaaaatgaacaatttgatttgattgtcaatgccttcagctacctgaatacatgtgtagagatttctgttcaagtggaggagtctcagaattatgaagcaaatattaatacctggaaaatcaatggcagtgaggttattcaagctggagggaggaaaacaaacatctggactattatacctaagaaattgggtaaagtgaatatcactgtagttgctgagtccaaacaaagcagtgcttgcccaaatgaaggaatggagcagcaaaagctaaactggaaagacactgtggtcaaaagcttcttagtagagcctgaaggtattgaaaaggaaaggacccagagtttccttatctgtacagaaggtgccaaagcctccaagcagggagttttggacttgccaaatgatgtagtagaagggtcagccagaggctttttcactgttgtgggggatattctaggacttgccatgcagaatctggttgttctccaaatgccctatggaggtggagagcagaatgctgccctactagcatctgatacttatgttctggactatctgaaatctactgagcaactgacagaggaagttcaatctaaggctttctttctcttatctaatggttatcaaaggcaattatctttcaaaaactctgatggttcctatagtgtgttttggcagcagaatcagaaaggaagcatatggctcagtgctcttacttttaagacattggagagaatgaaaaaatttgtattcattgatgaaaatgttcaaaaacagaccttaatctggctttcaagccaacagaaaacaagcggctgctttaagaatgatggccagcttttcaaccacgcctgggagggtggagatgaagaggacatttcactcactgcatatgttgttgggatgttctttgaagctgggctcaattccacttttcctgctctacgaaacgcactcttttgccttgaagcggcattggacagtggtgtcactaatggctacaatcatgcaattctagcttatgcttttgccttagctggaaaagagaagcaagtggaatctttactccaaaccctggatcaatctgccacaaaactaaataatgtcatctactgggaaagagaaaggaaacccaagacagaagaatttccatcctttattccctgggcaccttctgctcagactgagaagagttgctatgtgctgttggctgtcatttcccggaaaattcctgacctcacctatgctagtaagattgtgcagtggcttgcccaacagatgaattcccatggaggcttttcttccaaccaggtgattaatgtaggcctgatattaatagcaatatgcggggaagaggggctcttctctaagaatcaaaacactgtcacctttagcagtgaaggatccagtgagatccagtttaacggtcataaccgcctactggtccaacgttcagaagtaacacaggcacctggacaatacacagtagatgtggaaggacgcggttgtacatttatccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagaggtaaataatagaagcctaatctttcatcacaaagacagctacatagagtataaagataaaataaatacttgtttagccgtagtttagcaaaacaaaactatagaattcttcttcaacattcacctttgtatttttgcgctaacactggagagctggtgtacttcatttgtaccaattagcagtcagtatttcccatggttcatcatatgtttttctttagttgctacctgtgtttatgaaaacatcatggcaccaaggaatgttccataaaacagaacgtgacgtagaaaagagtggacattcagttctgcagtggcgctgtcatttgttctaatatctattctctatccttccctaacaatttcttcaaagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaagaagaatatgccctagctttttaccacatcaacagtagttcagtttccgagtgagacaaagcaattactggaagaagtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttgc

SEQ ID NO: 28147 - DNA, 524 bp, Homo sapiens
ctctaccgttcgggattgttcatgacatttcatgtcgctgtaattgttacagaatctgggacagcttaaattttcggatcccaataatgtacctatggtgaacaagttgttgcaactggagctcaatgatgaatttataggaaattacactacggatgagaatggcgaagctcaattttccattgacacttcagacatatttgatccagagttcaacctaaaagccacatatgttcgacctgagagctgctatcttcccagctggttgacgcctcagtacttggatgctcacttcttagtctcacgcttttactcccgaaccaacagcttcctgaagattgttccagaaccaaagcagcttgaatgtaatcaccagaaggttgttactgtgcattactccctaaacagtgaagcatatgaggatgattccaatgtaaagttcttctatttgatgatggtaaaaggagctatcttactcagtggacaaaaggaaatcagaaacaaaggttaacataaagttctct

SEQ ID NO: 28148 - DNA, 1824 bp, Homo sapiens
cagggcgcgggcgcccgccctgctctgtgacgcgcggcccgaggcgcacgcagggctcacaccacctgtcctggcctccgacccgggccgactatggcggcgctgcggctcctggcgtcagtgctcgggcgcggggtccccgccggcggctcagggctcgcgctgtcccagggctgcgcccgctgctttgccaccagtccccggctccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccatccgggcagacttcgccctggtgaaagggtggaaggccgaccgggcaggaaacgtggtcttcaggagaagcgcccgcaatttcaacgtgcccatgtgcaaagctgcagacgtcacggcggtggaggtggaagagatcgtggaggtgggggctttccccccagaagacatccacgttcctaacatttatgtagatcgcgtgataaaggggcagaaatacgagaaacgaattgagcgcttaacgatcctgaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaagagctgacgctgagggagctctgggagggcctgacggtggacgacatcaaaaagagcacggggtgtgcctttgctgtgtccccgaacctcaggcccatgcagcaggtggcaccctgacgggacctggatctgggcggggtggtgcgctcctcagggcgggtgccaccgggttccccaggggaatacatgtccccagctctgggaggggtttgctactggcctcctactttcctccctaggtggacagtgctcctctagagagctgcgactttaattaaaaacaacaggaaaaca

SEQ ID NO: 28149 - DNA, 2430 bp, Homo sapiens
gcgctctactcctgtaacggaaaggtcgcggcttgtgtgcctgcgggcagccgtgccgagaatgaaccccagcacccccagctacccaacggcctcgctctacgtgggggacctccaccccgacgtgactgaggcgatgctctacgagaagttcagcccggcagggcccatcctctccatccggatctgcagggacttgatcaccagcggctcctccaactacgcgtatgtgaacttccagcatacgaaggacgcggagcatgctctggacaccatgaattttgatgttataaagggcaagccagtacgcatcatgtggtctcagcgtgatccatcacttcgaaaaagtggagtgggcaacatattcgttaaaaatctggataagtccattaataataaagcactgtatgatacagtttctgcttttggtaacatcctttcgtgtaacgtggtttgtgatgaaaatggttccaagggttatggatttgtacactttgagacacacgaagcagctgaaagagctattaaaaaaatgaacggaatgctcctaaatggtcgcaaagtatttgttggacaatttaagtctcgtaaagaacgagaagctgaacttggagctagggcaaaagagttccccaatgtttacatcaagaattttggagaagacatggatgatgagcgccttaaggatctctttggcaagttcgggcccgccttaagtgtgaaagtaatgaccgatgaaagtggaaaatccaaaggatttggatttgtaagctttgaaaggcatgaagatgcacagaaagctgtagatgagatgaatggaaaggagctcaatggaaaacaaatttacgttggtcgagctcagaaaaaagtggaacggcagacggaacttaagcgcacatttgaacagatgaagcaagataggatcaccagataccaggttgttaatctttatgtgaaaaatcttgatgatggtattgatgatgaacgtctccggaaagcgttttctccatttggtacaatcactagtgcaaaggttatgatggaaggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggcttacctcactaacgagtatatgcagagaatggcaagtgtacgagctgtgcccaaccagcgagcacctccttcaggttacttcatgacagctgtcccacagactcagaaccatgctgcatactatcctcctagccaaattgctcgactaagaccaagtcctcgctggactgctcagggtgccagacctcatccattccaaaataagcccagtgctatccgcccaggtgctcctagagtaccatttagtactatgagaccagcttcttcacaggttccacgagtcatgtcaacgcagcgtgttgctaacacatcaacacagacagtgggtccacgtcctgcagctgctgctgctgctgcagctacccctgctgtgcgcacggttccacggtataaatatgctgcgggagttcgcaatcctcagcaacatcgtaatgcacagccacaagttacaatgcaacagcttgctgttcatgtacaaggtcaggaaactttgactgcctccaggttggcatctgcccctcctcaaaagcaaaagcaaatgttaggtgaacggctctttcctcttattcaagccatgcaccctactcttgctgggaaaatcactggcatgttgttggagattgataattcagaacttctttatatgctcgagtctccagagtcactccgttctaaggttgatgaagctgtagctgtactacaagcccaccaagctaaagaggctacccagaaagcagttaacagtgctaccggtgttccaactgtttaaaattgatcagagaccacgaaaagaaatttgtgcttcaccgaagaaaaatatctaaacatcgagaaactatgggaaaaaaaattgcaaaatctaaaataaaaaatgcaaaatctaaaataaaaaatggaaaggaaactttgaaccttatgtaccgagcaaatgcaaggtctagcaaatataatgctagtcctagattacttattgatttaaaaacaaaaaaaagattacttaattttgatttaaaaacaaaaaatcgtaaaatacaaaaaccagttaatgttttgtagaccctgggaaaagaattttcagcaaagtacaaaaatttaaagcattcctttaattttttaattctttactgtggaatagctcaaaatgtccattctgttttaagtaacagaattgataactgagcaaggaaacatggtttggattataaaattcttgctttaataaaaatttcttaaacagtgaaa

SEQ ID NO: 28150 - DNA, 493 bp, Homo sapiens
ctttccgccatcttgattctttgtcactgaccgagactcagccgtgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcagggtattgcacctagtggggagatcgaaaatgaaggagcacctgccgttcaagggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaa

SEQ ID NO: 28151 - DNA, 2807 bp, Homo sapiens
gggggagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcttctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaaggctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaaaaaaaaaaa

SEQ ID NO: 28152 - DNA, 2570 bp, Homo sapiens
gggggagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcttctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaaggctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaaaaaaaaaaa

SEQ ID NO: 28153 - DNA, 2346 bp, Homo sapiens
cgcacgtctctcctgagaactaccgagtaggtcgggcctgcctgtgagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcttctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaaggctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaaaaaaaaaaa

SEQ ID NO: 28154 - DNA, 4271 bp, Homo sapiens
atgttggggctgaggggaaggaggagaagctcctgaagcggcgggcgcgcagcgggagtgggagtggggtcggaccagggcagctagaagccctgcccttccgcctcagcggatcatgacccgggcggcggccgcgaaggtcgcggtggtgggggacgtgccctggcggggcgggcgctgaaagatgatgccgtttccggtgacaacccagggaccaccgcagccggcgccgccgccgaatcgctacggcgtctcctcgcctatcagtctagcggtccccaaggagacggactgcctcctcacccagaggctaatagaaaccctcaggcccttcggggtcttcgaagaggaagaggaactgcagcgcaggattttagttttggaaaaattaaataatctggtaaaggaatggatacgcgaaatcagtgaaagcaagagtcttccccagtctgtaattgaaaacgttggaggaaagatttttacgtttggctcttacagattaggagtacatacgaaaggcgcagatattgacgccttgtgcgttgcaccaagtcatgtggatcgaagcgactttttcacctcattctatgctaaactgaaactacaggaggaagtgaaagatttaagggctgtcgaggaggcatttgtgccagttatcaaactgtgttttgatgggatagagattgatattttatttgcaagattagcactacagactattccagaagatttggacttaagagatgacagtctacttaaaaatttagacattagatgcataagaagccttaatggttgccgggtaaccgatgaaattttacatctagtgccaaacattgacaacttcaggctgactctgagagccatcaaactgtgggccaagtgccacaatatctattccaatatattaggtttcctcggaggtgtttcctgggccatgctagtagcaagaacttgtcagctttatccaaatgcagtagcgtcaactcttgtacggaaattcttcttggtattttcagaatgggaatggccaaacccagtgttactgaaggagcctgaagaacggaatcttaatttgcctgtatgggacccaagagtaaatcccagtgataggtaccatcttatgcctatcatcacaccagcatacccacagcagaactccacatacaacgtgtctatttcaaccaggatggtcatgattgaggagtttaaacaggggcttgctatcacacacgagattttgctaagtaaggcagagtggtccaaactctttgaagctccaagcttctttcaaaagtacaagcattatattgtacttctggcaagtgcatcaacagaaaaacaacatttagaatgggtgggcttggtggaatcaaagatccgaatcctggttgggagcttggagaagaatgaatttattacactggcacatgtgaatccacagtcatttccagcacccaaagaaaatcctgatatggaagaatttcgtacaatgtgggtgattgggttagggctaaaaaagccagataattctgaaattctcagcattgatctcacctatgatatccagtctttcacagatactgtttataggcaagcagtgaatagtaagatgtttgagatgggtatgaaaattactgcaatgcatttaagaagaaaggaacttcaccagctgctgcctcatcatgtgcttcaggacaagaaagcacactcaacagaaggtagaagattgacagatttgaacgacagcagctttgacttgtctgcaggctgtgaaaacagcatgtctgtgccttcatctactagcactatgaagacaggcccattgattagcagttctcagggtagaaacagtcctgccttggctgtaatgacagcatctgtggctaacatacaggctactgaattttccttgcaacaggtgaataccaatgaaagttcaggggttgcattaaacgaaagtattcctcacgctgtctctcagcctgccatttctccatcaccaaaggccatggtcgccagagttgtttcttcaacatgtctcataagccatccagaccttcaggaaactcagcaacaaacatatctaatcctatagttggagtctagaggatattcttgcctcataaagaagaaaggaccaagaaaaccaaaacggaagaggagaaactcaatacaaagacaagtacaactccattagaaaaattcagacagcatcttctctattggcctctcagggaacatcagtatagatctttccggtatccctgttctccctgcaaatccaattcctgttatcaagaattcagtaaaacaggttgaatggttaaaaacaacctcaagggtccatgaacaatatctgccaactgaacctgttgtcttcaaatactaaggaaggagaatgaggggtacgggactagatatgacttgaaatagattgaggctcatttggtaacttcctttactgagccagtcttgatcagaagtccacattagtatgtgacagctagaggtactgttattaatgtatcagcaacagttacattaactatttcaaaggactactgcccttaaaatgaaaaaacctttcagctatgtttgtacccgtgactgacatctggactggatttatgcttgatgcattgttgggaaaatatgcaatacaaactggtatcagaattccttatactgatgaggcactttatattttttattagaaagtagaactaattttagatttttcaaattggtgaattttatttttccctgaagaggtttcttcactattaatcttaaaattggataccattgtgcagcggtgtactgtacttcagagaaagcataaaagtacatctagctcagtccctatgaggtagctgtaaccctttaaaatgaaatgtcaactttaaggtatgtttttgacatcaaccattagtaggtctttggttttgatggcacactatggagaaaggacacactggttttaatctgtagaactgttttagagtaattagcaatcaaacattttctttgagctatcaaagctccatattctcttgtcctcaatcattagtcctaaaacaaaaaagctttttgcctccctctcttctctttgcctgtatgcacacagtatgcttatgtgtcatttcacaagaaaaaaggaataatattctctaaaccatgatgtgaaactgacaatcctgtggccacatggcacaaaacaccaaatattggttatgatgaaacaccacattttagcaaaactttactaaatgtaatgtctatgagatatgtttctgatcttggatgaccatttgatcactgcatatgagaagttttgttcattccacagaatacctccttataggaaagttaatttccaattgcacacataagcaaaaaggcattttcttcaagaattttaaacacttttatttttaaacgatttatcaaaattcatctctaaattttacatgtagaaacataaaaaagtaatttctagcaagcacttgacatcttactggctttctgctcttttagtctacaaaagatcagcaatactttaagttaaaaaaaatctcataattaagcagtagagcatctatgattaggaaatgtgaggggcaacagatgtgaatgaatgaaagttgagtctttcttaatctagacagcaaacttaacaggctttccaattagccttgctttaacccctcccgtccctcctctaactctgcacttttcatgttaaactgcaattacttaaactcttttcctgtcctgcattaattttccaaagttggaatatagtcatgtccttttatgctgtagagacttttctttcaccattactttctgatatctagtacacagtatttctttttctcacatctttgccgtttcaccacaataataaatcgggtgaagtgtgcacaatatctgtattttgaatggctatggcgttaggttgaaatggccaggcacaaatttagtctggtcattttgtttacacattgggaaaaaaattagtttattaaacattacctgtaactgtgtctgttttaccaagctggaaccttgggactttttatttctaatttttattacctgaatgtcagaccattttttcatgtgatgtacctagtgagtggagtttgctttgttttatggtatctgtactcctggtatattcaagcactgttttgaaaacagatgacttatttctccattaaaaatgcaataaaaataaatggcaaacaaaaaaaaaaaaaaaa

SEQ ID NO: 28155 - DNA, 4003 bp, Homo sapiens
gctggcggcagtggccggtgtgagcgcagagccgggccctgggcagcagcggcagcgcggtaggacctcgcgcagcgtccgcgggctccggggcgggggcgccagcggcgaagccccctccccggggaggcgggacctgggggagctcccgagccggggagcggcggcggccgggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccagaatcacttccacggtgaatcagagaagggattgtaccactcgtcacgtgtgttgggaaagaagaaagggtgagaaaccctggcctaaacaatccatcccacagatcctcaggcattcctttgtgtacttggtttttcaccactgagctttaaataagaatggaaatacaagggaaaacctgcgttgtaaacatgaggatttgggaacagatctaggacatgccactgaattgaagaccacccatcttccaggcagggccagaattacagaaaacaattctggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatctccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattatactatccagttttattactaaaaaagactggttttaattttaccaatgtgtgaactataaaagctttttgcctacagattttacattttaaagttatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaataaaaaaaaaaaaaaaa

SEQ ID NO: 28156 - DNA, 3058 bp, Homo sapiens
tgaattcaaaacagttactctgaatggtctttgctaagaacaatttaatgattaagtaaggtcagtgtccttggaagtccaaactctagccagatttccctggtctacacccctagggataaggtaaatgtttaagcacacagtgaacttcctgaggcccccaaatctaatggaactagctattgagggctaaaagaggatggtttttttagaaaactcgaagcaaatctctcaggctggggatatttcaaagactactactattattattaataacaattgcaatatttgttgagtccctaaatgaagctaaaactttgttctaataaatttaatctttacagcaacctatgaggtagataatattgtcattcccatgagggagctaaggatcagagaaggtaagtcacttgtctaaggtcacatagctagcatgttatgcaatcaggagtcaaacctggtttgtctgaatctgaagtccatctgctctgtgcacttttataccgtctgctttttcctttattcctaaccttcttccattctgattcccactgagtagtggacaggaaccactgaagtttgcctgacaccatcaaccaggccctagtcacctggctttgcctttgccctgctgtgtgatcttagctccctgcccaggcccacagccatggccatggcccagaaactcagccacctcctgccgagtctgcggcaggtcatccaggagcctcagctatctctgcagccagagcctgtcttcacggtggatcgagctgaggtgccgccgctcttctggaagccgtacatctatgcgggctaccggccgctgcatcagacctggcgcttctatttccgcacgctgttccagcagcacaacgaggccgtgaatgtctggacccacctgctggcggccctggtactgctgctgcggctggccctctttgtggagaccgtggacttctggggagacccacacgccctgcccctcttcatcattgtccttgcctctttcacctacctctccttcagtgccttggctcacctcctgcaggccaagtctgagttctggcattacagcttcttcttcctggactatgtgggggtggccgtgtaccagtttggcagtgccttggcacacttctactatgctatcgagcccgcctggcatgcccaggtgcaggctgtttttctgcccatggctgcctttctcgcctggctttcctgcattggctcctgctataacaagtacatccagaaaccaggcctgctgggccgcacatgccaggaggtgccctccgtcctggcctacgcactggacattagtcctgtggtgcatcgtatcttcgtgtcctccgaccccaccacggatgatccagctcttctctaccacaagtgccaggtggtcttctttctgctggctgctgccttcttctctaccttcatgcccgagcgctggttccctggcagctgccatgtcttcgggcagggccaccaacttttccacatcttcttggtgctgtgcacgctggctcagctggaggctgtggcactggactatgaggcccgacggcccatctatgagcctctgcacacgcactggcctcacaacttttctggcctcttcctgctcacggtgggcagcagcatcctcactgcattcctcctgagccagctggtacagcgcaaacttgatcagaagaccaagtgaagggggatggcatctggtagggagggaggtatagttgggggacaggggtctgggtttggctccaggtgggaacaaggcctggtaaagttgtttgtgtctggcccacagtgactctctgtgcacgactcaactgccaagggcatcactggccaattcttggatttagggattggctaggagttgctggggtccactcctgggcctgccccagctccttgcccagggagagggaaagagttaacggtgtgggccactccagcttgcccttccactgccactcactggggtgaggctgggggtcagcttggtgaggattggggcttctagattgtctaggcaggaggtgaaacttaggccagagtcagatttgagctgagccaggggaggccttggcaacctacttctactcagatttcattgctggatgcggaaggggtaggcccaaaatatatacaggatcttactgtcccttgaagcccagccacaagtgttggagctgcagagagaccccaaaggtagtagattgtgccagatacaaatgggtcccatccagtgcttcatactccttcagtcactatcccagacagtgagccccagatctcctagctctggcttctgtgtcccacacggcctgttcccagcttctctcctggttcccttgttaaggattcatttatccattcagtgtttcctgggcctctgctcagaggcaggtcaccactgggccctgtggatcaatgcaagatgacaaaggctttttttttttttttttttttttttttttttgaggagtttcgctcttgttggctaggctggagtaaaatggtgcgatctcggctcactgcacctccgcctcccaggttcaagcgattttcctgcctcagcctcccgagtagctggggttacaggcatgcaccaccatgcctggctaattttctgtatttttagtagagacggggtttctccatgttggtcaggctggtcttgaactcctgacctcaggtgatctgcccgtctcggcctcccaaagtgctgggattaccggcatgagccactgcgcctggccgacaaaggctttgatatcagaatgaactgtcaagggaggtgctggagagggattaacctgtgctgcctgggaccctcagggtcttaggttggggagtgtgaataggagtttgcagatggagaataggaagggcattccaggcagagggaaacctgtgcagagaccaagaggtgtggaaggaaaagtggggttggggctgggtggtctggattatggcctggatgcaataaagtactgtgacagtagccaaaaaaaaaaaaaaaaaaaaaaaaaaaaaaaaaaaa

SEQ ID NO: 28157 - DNA, 2103 bp, Homo sapiens
atgccgcggcgcctgcagccccggggcgcgggcacaaaaggccctccggccccggccccggcagcttcgggggccgcccggaactcccactctgccgcctcccgggaccccccagcgtctgccaagccgctgctgcgctgggacgaggtgcccgacgacttcgtggagtgcttcatcctgtcgggctaccggcgtctgccgtgcacggcccaggagtgcctagcctcggtgctgaagcctaccaacgagacgctcaacttctggacgcacttcatcccgctgctgctgttcctgagcaagttctgccgtctgttcttcctgagcggcggcgacgtgcccttccaccacccgtggctgctaccgttgtggtgctacgcgtcgggagtgctgctgaccttcgccatgagctgcacggcgcacgtgttcagctgcctgtcgctgcgtctgcgcgccgccttcttctacctggactacgcgtccatcagctactacggcttcggcagcacggtggcctactactactacctgttgccaggcctcagcttgctggatgccagagtcatgactccatacttgcagcagcgcctgggctggcacgtggactgcacgcgccttatcgccgcctaccgcgccctggtgctgcctgtggccttcgtgctggcggtggcttgcactgtggcctgctgcaagagccgtaccgactggtgtacctacccgttcgcgctgcgcaccttcgtcttcgtcatgccgctcagcatggcctgccccattatgctcgagagctggctcttcgacctgcgtggggagaaccccacactcttcgtgcacttctaccgccgctacttctggctggtggtggccgccttcttcaacgtgagcaagatccccgagcgcatccagccgggtcttttcgacattatcggccacagccaccagctcttccacatcttcaccttcctcagcatctacgaccaggtgtactacgtagaagagggcctgcgccagttcctccaggcgccgcctgccgcacccactttctcgggtactgtgggctacatgctgctgctggtggtctgcctggggctggtaatcaggaagttcctaaacagctccgaattctgcagtaaaaagtgagcctccgccttggaggagactactggttcgcccatctgtttggagtttctgttgttgctattgttggtttgttttcaaatttcattgtgttttcttctttgctcaaggaaggtgctgcaaaaccatagggaaaaagttcactgctacaaagggatcccaacccactggaggctttgaagtagggaggttggcaggggtggtcaagcgggagggagatagtcacttgttcttgcccctggaaaaaattcaggtgatgtctttgacatccagggatttctcaaaggcagtgagtaaaatcccaaataaagccccaaagagtttgcttttccaatcatctgtgccattggtaataaggagtagcccctgtgaggtcaggtacacagtaaagagggtaaatagaatccttgggaacttctgtttcagtctgaggaatgcttggatttgtcaaaagaatggagctttgtaggaaacaggcacaaagacgcaaacccagggcttaacctgctagaaaatgcatggaatgtgaacacaagttaattatttcaaaatgtttttcagatgttatttaaatagtaatatatacattgatttttcataatttatcaaagcctgtggtacgcactgaattttctttgtcacatagttttgaatttcacagccttctgcattgcatacacttgaactggacatcaggggaagctgcttgagagttctcaattactttcttaaacagtgttttctgaaggcgtgtgtcatgatacaactgtgaattctaccttagggactctggttaaactattggtgaggagctcgagtggtttgtatagaccccagatttttgtttactttaatgtattccacaaaacccatcctggtttttgttagtttgttttgtttttaatctttttttttccttctctacttatttaaattgccactggaataaatgtgccttttgaagcaaagtcc

SEQ ID NO: 28158 - DNA, 3161 bp, Homo sapiens
acgctgcctccatgcctgcctcccctctctgccacgcccccaccacgcgctttgcactctggggcccacgcacttccctgaagagtctagaagctgctcctcatttccagactttccgggcgcccaccaggctcccgggctctcaccggagaccacagggaggagcttcaaggtaccccaagtccctgcggcctccagcagtgaagagttccacaagggagtcttcctacgtcactgaataatgaatgaagatgagaggggaaaagagaagagacaaagtcaatccaaaaagctctcaaaggaaattaaactggattccatcatttcctacctatgattacttcaaccaagtgacgctacagttattagatggctttatgattacactgagcacagatggagtgatcatttgtgtggctgaaaacatctcttctcttcttggacatttaccagctgagattgtgggcaaaaaattattaagccttctgcctgatgaagagaaagatgaagtctaccaaaagattattctcaaatttcctttactaaactcagaaacacatattaaattttgctgtcatttaaaaagaggaaatgtcgaacatggtgatagttctgcttacgaaaacgtgaaatttattgtgaatgtaagagatatttgtaatgagtttcctgtggtctttagtggcttgttttccagccacctctgtgctgactttgctgcatgtgttcctcaggaggatcggctttatcttgtggggaatgtttgcattctcaggactcagctcctgcagcaactttacacttcaaaggcagtcagtgatgaagctgtacttacacaagattcagatgaggaaccttttgtgggagagctcagtagctctcaaggtcaaagaggacacactagcatgaaagccgtgtacgttgaacccgctgctgctgctgctgctgctgctatctcagacgaccaaattgatattgcagaggttgagcagtatggtccacaagaaaacgttcacatgtttgtagattctgattcaacttattgctccagtacagttttcctggatactatgcctgaatctccagccttatccttgcaagactttcgaggtgagcctgaggtgaatccattgtacagggcagacccagtggacctggagttctcggtggatcaggtggactcagtggaccaggagggcccaatggaccagcaggacccagagaacccagttgccccgttggaccaggcaggcctgatggatccagtggatccagaggactcagtggacctgggggctgctggcgcaagtgctcagccattacagccatcatcaccagttgcatatgacatcattagccaggaactggaactgatgaagaagttgaaggagcagctagaagagaggacttggttgctgcatgatgccatccaaaaccagcagaatgcattggaattgatgatggatcaccttcagaagcagccaaacacattacgccacgttgtcattcctgatctccaatcttcggaggcagtgcccaagaaacaacagaaacaacacgctgggcaagtgaagcggcctctcccacatcccaaggacgtcaagtgtttctgtggtttatctttatccaactctctcaaaaacactggggagcttcaggagccttgtgttgccttcaaccagcagcaactggtgcagcaagaacaacacctgaaggagcagcagcggcagctgcgggagcagctgcaacagctgagagagcaaaggaaggtgcagaagcagaagaagatgcaggagaagaagaagctgcaggagcagaaaatgcaggagaagaagaagctgcaggagcagaggcggcaaaagaagaagaagctacaggagcggaagaagtggcaggggcagatgctacagaaagagccagaggaggagcagcagaagcagcagttgcaagagcagccactgaagcataatgtcatcgtggggaatgagagggtgcagatatgcctgcaaaacccacgtgacgtatctgtgcccctctgcaatcaccctgttagatttttacaggcccaacccattgttcctgtccagagagcagctgaacaacagccctctggcttctatcaagatgaaaactgtgggcaacaggaagatgagagtcaaagtttttatcctgaggcgtatcaagggccccccgtgaaccagctgccattgatagatacctcaaactctgaggcaatttcttcttccagcattcctcagtttcccataacttcagactcaaccataagcaccctggagaccccacaggattacatccggctttggcaagagttgtctgattcactcggtcctgttgtccaagtgaacacttggtcttgcgatgagcagggcaccctgcacggccaacccacctaccatcaggtgcaagtttctgaggtaggagtcgagggacctcctgatccacaggctttccaaggccctgctgcataccagccagaccagatgagatctgcggagcagaccagattgatgcctgcagagcaacgtgactcaaataagccgtgctaacagtactttcatgaccagtgatgaggggaaatggggggagggggcaggccaatgaggtctgcatggccaggggaccttcaaggtgcgtaaagtcccttggggtagggtttagtgggtagagacttatttgtttcctgataggttatgtttgtaattgtttgttaagcacagcctgtttcttggaagttatgctgtagaggcagcctgtgatccgtagtatgctagggtttgacagcagccagccacagctggatctgatgtcttgtctgccccgcccagctttgcatatccatgttctaccacaggaaggtggcctgccaagagtctgctcaaagttttcaacataaagaaaaaagaaaaaaaaatgccaaagtgcttttcaatctagtaaatctagagggttgttttgtcttagccacaagaattccgaggtcttgaccctgatgatcaacctgcctcccctccatagtcttgttggagaagcccagagagaatgggactccaactaagggaacctgaaatcaactcaatggaggcacttcagagctaaaataattatggctaccttgcttaataaacattttcgttcactgc

SEQ ID NO: 28159 - DNA, 1899 bp, Homo sapiens
agcgcgcgactttttgaaagccaggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaaaaaaaaaaaaaaaaaaaaaaaaaaaaaaaaaaaaaaaaaaaaaaa

SEQ ID NO: 28160 - DNA, 2571 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatgtaagtccaactttcgagttttggctttaaatatttttcatatttaacttgtctaatcatcttttcaaatatcactttaaaaaatgtcttcaaggtgttcactaacgttgaaataaatcataccattgaatgtagatatcctattaatggcagttttgtcttgaatggaactagaaa

SEQ ID NO: 28161 - DNA, 2535 bp, Homo sapiens
atggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataa

SEQ ID NO: 28162 - DNA, 3291 bp, Homo sapiens
ttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtga

SEQ ID NO: 28163 - DNA, 2506 bp, Homo sapiens
tgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaa

SEQ ID NO: 28164 - DNA, 2427 bp, Homo sapiens
atgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaa

SEQ ID NO: 28165 - DNA, 2619 bp, Homo sapiens
agaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgatttt

SEQ ID NO: 28166 - DNA, 3070 bp, Homo sapiens
agaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaaaaaaaaaaaaaaaa

SEQ ID NO: 28167 - DNA, 2475 bp, Homo sapiens
atgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaa

SEQ ID NO: 28168 - DNA, 2498 bp, Homo sapiens
tgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataa

SEQ ID NO: 28169 - DNA, 2451 bp, Homo sapiens
atggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttag

SEQ ID NO: 28170 - DNA, 2439 bp, Homo sapiens
atggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataa

SEQ ID NO: 28171 - DNA, 2370 bp, Homo sapiens
atggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataa

SEQ ID NO: 28172 - DNA, 2445 bp, Homo sapiens
atggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtag

SEQ ID NO: 28173 - DNA, 6388 bp, Homo sapiens
ctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctc

SEQ ID NO: 28174 - DNA, 3084 bp, Homo sapiens
caatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggtt

SEQ ID NO: 28175 - DNA, 2655 bp, Homo sapiens
atggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaa

SEQ ID NO: 28176 - DNA, 3173 bp, Homo sapiens
atggaggcgggaggagagcgatttcttagacaaaggcaagtcttgcttctctttgtttttctgggagggtctctggctgggtccgagtcaagacgctattctgtggctgaggaaaaagagaagggctttttaatagccaacctagcaaaggatctgggactaagggtagaggaactggccgcgaggggggcccaagttgtgtccaaagggaacaaacagcattttcagctcagtcatcagacaggtgatttgctcctgaatgagaaattggaccgggaggagctatgcggccccacagaaccatgcatactacattttcagatattactgcaaaaccctttgcaattcgttacaaacgagctccgtatcatagatgtaaatgaccattctccggtattctttgaaaatgaaatgcatctgaaaatcctagaaagcactctgccaggaacagtaattcctttgggaaatgctgaggacttggatgtgggaagaaacagcctccaaaactacactatcactccgaattcccacttccacgtactcactcgcagtcgtagggacggaaggaagtacccggaactagtactggataaagcgctcgatcgggaggagcagccggaactcagcttaacgctcaccgcgctggacggcggctctccccctcggtctgggacagcccagataaacatccaggtcttagatataaacgacaatgcaccagaatttgcacagccgctctatgaggttgcagttctagagaatacccccgttaactctgtcattgtcactgtctcggcttctgacttagatacaggaagttttgggacaatatcatatgcattttttcatgcttctgaagaaattcgcaaaacttttcagctaaatccaattactggtgatatgcaactggtcaaatatttgaattttgaagcgattaatagttatgaagtcgacatcgaggccaaggatggcggaggcctatccggaaagtctacagtcatagtccaggtggttgatgtcaacgacaacccaccggaactgaccttgtcttcagtaaacagccctattcctgagaactcgggagagactgtactggctgttttcagtgtttctgatctagactctggagacaacggaagagtgatgtgttccattgagaacaatctccccttcttcctgaaaccatctgtagagaatttttacaccctagtgtcagaaggcgcgctggacagagagaccagatccgagtacaacattaccatcactatcactgacctggggacacccaggctgaaaaccaagtacaacataaccgtgctggtctccgacgtcaatgacaacgcccccgccttcacccaaatctcctacaccctgttcgtccgcgagaacaacagccccgccctgcacatcggcagtgtcagcgccacagacagagactcaggcaccaacgcccaggtaacctactcgctgctgccgccccaggacccgcacctgcccctctcttccctggtctccatcaacgcggacaacggccacctgtttgccctcaggtcgctggactacgaggccctgcaggcgttcgagttccgcgtgggcgccacagaccgtggctccccggctttgagcagcgaggcgctggtgcgcgtgctggtgctggacgccaacgacaactcgcccttcgtgctgtacccgctgcagaacggctccgcgccctgcaccgagctggtgccccgggcggctgagccgggctacctggtgaccaaggtggtggcggtggacggcgactcgggccagaacgcctggctgtcgtaccagctgctcaaggccacggagcccgggctgttcggcgtgtgggcgcacaatggcgaagtgcgcaccgccaggctgctgagcgagcgcgacgcggccaagcacaggctggtggtgctggtcaaggacaatggcgagcctccgcgctcggccaccgccacgctgcatgtgctcctggtggacggcttctcccagccctacctgcctctcccggaggcggcaccggcccaggcccaggccgacttgctcaccgtctacctggtggtggcattggcctcggtgtcttcgctcttcctcttttcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcagttaagtgttaataaggatctactgagcctcgtcttagttaatctgtggaaagtccttttttactgctttgtccattggagaggtcttttttggtctggttcaaggcaagtagcaagaatagagcaaaatatcaaatccagggatggcttaggtttcattaacagtactggaaagtagttgtgtggctctgaatgttttgtatttcaatcgagaatccttagtcgatagaacattttgtttatatattgattctactttttctgtagttaatccttgcatattctcctttcatcctggcttgccaacgcagtcttaattccgccttttttttttctaatggggagcaaaaagaaattcactgtcttttaatagtgatttcaaatagcttattaaaataactccattcaaattttacattataaagcaatgtagagagagttccaaaccaccaattttataatttcccttgttgaatatattcatataatgtgttctataatatgcccaaagcagctttgtctatagttaacaaagttttaaggatagacaagaatgtgttttctttaataaatagtaatatatcatctttttagggatatagtactcaaatgaaagtaatttagttcattttctgtgttgacatttgcaattaatatttcaatattttatgtgcttatattggccaaaatatggacacaaatatagactaatatgggtaattaccctttggtttatctaaagtgtgttcatgatgactgaggaaaaaaattaaacctatgccattta

SEQ ID NO: 28177 - DNA, 3655 bp, Homo sapiens
gttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgaagagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttttaggacatcttttgatacctttaaaagaaccactgtcaagtaatccttaaaaaaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgc

SEQ ID NO: 28178 - DNA, 5447 bp, Homo sapiens
agaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaatagaggtggcaaagtgcttctgaaatagtcgagaaaaagacagattccaacctcctcagtccagccactgagacctgatgttggaacgcatcagctccttccagttccatgaatgtggctcatagacaaagccttgctttaggctggttataaaaggtcatctagtgtgaaccttaactttttattcaaaggacagttttgtcaagaactccacgtaaggcctgatgtgctcctggttgtactttctcatcactggtttgacttcattgttttgcagaaattaccttaatccgtgggaactgcaacaaagaaaaacttcctaatatataaaaaagaggagctgctttgctttgcctccaggtttagcggacaagaaatgtctcctgaagcttctccttaaaggatgctattatggaatggcttttcccatttctgaccagttaacagtttcatagacctcaagtaacagtttgaggtatcaaacatagtataccaatagggggtgctacctgcacgtatctgttctatatatgctccaatatgtcatccccgggtgtatcccatgtgcaatatgagtatatagtggtggcattttataatagaccccactcctgcgctccaccataatactcctctgaaatccttggtctcaagaaacatctgttctcttgtgacttgggcactttgtcaagcttattccagattcctgtggaaacgttttatcccaaccaggaaattagtattttgttctcgtggcctcctataacatttttgggtgaaggagaactcaagactttttacagagaactgtgggctcagttatgatctcagcatctgaatggtctaggtagtatcaccattatctctggccctaggtttgccaagtaggatgaagactctaagtgttcctgctgagttgtccaaaggtcctgctccttagtcacctgtgcgaaatgagcagggagagttaaggcatagaaccaaactctttgggttattgtatgggtatgccagtaaattcagacacagagctggggtctgactgaatagaggcccaaaccagcaacttgtaggcagagcccagaatctcttgtgatagaaataccccttttcagaggccttgggaaccagccttctaggtgacaaggggacaaccagtgaaggaaggcggcatgtctttccccttcttgttggggttgaactacctccctatccacttggagatgagtgctgtctgctgtgaagcaaaactatgaggctgagctggcttggaacctctttgttcttggcactttccttctccaggactctgggaagcactcatatgggacagagggctggcaggaacatggcatgtgaagaagaaaacttctttttgcagtcaagggccacccagaatattgctcttcagagagggacaagggcctcattcttccatttggtctctgtcttccatcatgcactcaggtcaagccatgcaagtctgcctaccatttgagttagttggcacttgtagcagtgaaggatgaggccagccaggcaagggaaggtggcgggaacaagggaagagaaaaggaggaaagaagttcctggagggaggaaaggaggataaagaaaatctgctctcataaaaccatttcaggacctcactttacaggtgagactctcttgggaaggcctttgtgcccctgctccatggcccagggcagatagattcacttttacctgaatcttatactctggagcaaatagtgtatcaggctgactatacatttgcaggccttacacgccatactgacaggtgccacttacgtgactcatcagataatgtcaccattgctgccaattatgggaaataactaatgcctattccagggatgagcccaaaccacacataaatgggttctaaatctcaccctcctaacctgcagtgagtccccccgttccaccctcttgaggctgcaaatctactgagaaggaatgggaaggattctacaacccaacttttgatactttttggccatctctcagtctctcccagcccctacccccacaccacctccctgctcccaggcagagaccgggttgcactttgttagggccagcaggtcaactgtaatggccaagagtgagttaaggctggaatgagaaatatgccccaagcttggaggggtaagcaggaataacacaaagcaaggaaagagattctttttgccctagtgaggaaaggaagcttcagaatgagggctggaggatagcaacttaggactgcagaagggggcagcttatgaagatgggagaaagtgggactgaagttgtaggggagcaggagggtagtgattttccgcttttctttctttctttcttttactttctttctctttctttctctctctctctctttctttttctttcttctttctctttttctttcctctttttctttctttctttttctttctctttcttccttctttctttcattcttctttgttctttcttctttctttctttttttttttttttgagatggagttttgctcttgttgctcaggctggagtgcaatggcacaatctcggctcactgcagcctccacctcccaggttcaaggggttcttctgcctcagcctcccaagtagctgggattacaggtgcctgccacgacacccagctaatttttgtatgtttagtagagacggggtttcaccatgttggccaggctggtctcaaattcctgacctcaggtgattctcccgcctcggcctcccaaagtgctgggattatgagcacgagccacggcgtccagccgattttccgctccctttcaagtgttaactcaccccctgacaggtgaagagggaagggttccttttacgcacaaccaaggttagcaaatgcccatgcaggatatggggtccctgcctctctggttgcttcatttcagcacttctatattagctgcttatggggaccctaaaatgaactggtcacccctccaccagctaagaaacaagggtgggattgctgtgccataagtcacactgaacgacttgcttctggcaagcatgctcctgtgtgtcaggaccttaccaaggcaaagaaatgccaggctcaagaggagcaggacgtgagacattggcctggcttctaacctggtctgagtggaagagacacagcttagggatttcagttttgctcttaggctactagatactgttatttcaccccctgagggagggacaggaagagcacggatttattttctctccgtcttcagtacttattttagcatctagtcataccccagggagagatgcgagacggtgtcactggctcagctgaagcagatgagcccgtctctagcagagatgtgcctgtttcttaggcatccgttcagcactagtcttggccatcagatttttaaaaaagaaatagctcatgaggcatttgcaacttctcctctctagacttctttctagttttcctctgttgtgtcactgcgatgtgtccagggacaaagccataagtagagcatacatacttaagactatgctgtacatataagacaagacctgtctgggttaaagcacgaccttatgcccaagcatttactctggtgctgaataacgcgaactactggaatcagcctcccccaactctgcgcgccccctgcccccctgctcctatcccattcttgctctcaaatggaccacaccattctcaactcgtttataaataaagggatgcagaattgca

SEQ ID NO: 28179 - DNA, 873 bp, Homo sapiens
gaagcgggcgctcttccagcctggagaaggctgcgggtctccatccgtggcgcctcgccagctgcaggacgacgcgggctcttgaggggcagagcagcgcatcatgcaggatcccaatgaagatacagaatggaatgacattttaagagatttcggcattcttcctcctaaagaagagtcaaaagatgaaattgaagaaatggttttacgtttacagaaagaagcaatggtgaaaccatttgaaaagatgactcttgcacagctaaaggaagctgaagatgaatttgatgaagaagatatgcaggctgttgaaacatatagaaagaagcggttacaggaatggaaagctcttaagaaaaaacaaaaatttggagaattaagagaaatttctggaaatcagtatgtgaatgaagtcacaaatgcagaagaagatgtgtgggttataattcatctatacagatcaagcatcccaatgtgtttgttggttaaccagcatcttagtcttctagcaagaaagtttccagaaactaaatttgttaaagccatcgtgaatagctgtattcaacactaccatgacaattgtttaccaacaatttttgtgtataaaaatggtcagatagaagccaaattcattggaattatagaatgtggagggataaatctcaagctggaagaacttgaatggaagctagcagaagttggagcaatacagactgatttggaagaaaaccccagaaaagacatggtagatatgatggtatcttcaattagaaacacttctattcatgatgacagtgatagctccaacagtgataatgataccaaatagagagaaatattcaataaatagcttttagtataaaaaaaaaaaaa

SEQ ID NO: 28180 - DNA, 4784 bp, Homo sapiens
gaggcgacactgagtctccaagtccggagaggtgcccgagggaaaagaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaaggcctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatataaacacagcacagatttgtcagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagagtacatgacagaaatgacctatcactacttattatttctgaagcctaactgcaagagtgatttcttgagaacaagtaaagaactggctcgtgccg

SEQ ID NO: 28181 - DNA, 1679 bp, Homo sapiens
gccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaaaaaaaaaaaaaaaaaaaaaaaaaaaaaaaaaaaaaaaaaaaaaaaaaaaaaaaaaaaaaa

SEQ ID NO: 28182 - DNA, 3577 bp, Homo sapiens
ctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagaaaagtaaagaacaaggatatggaaaactaagcagtgatgaagacctcgaaataattgttgatcaaaagcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtgtaggattttgaagaagtgtttttcttaaagcagatacgatgacataaggcgtaaatatggcaaacagatcttttcattcacgtgctttctgggtctgtatgaacataagtaagacacaaggtactgtctcttcatgcattctctgcaggaagaaagtttgatggtatcgtgatttctattgagttcaaattaacttgcttaagtgtcatactttactggctttgccctgcacaccaatattccttttaaaccataaatattttaaataatatttcttaagagtgataaataacattttttcctaaaaattatgttttcttagtttcataataatctgcactgttcatccccttgcattctaagtgatagaagagcaacactttcaaaccaaatctcactgaatgccagtgatttcatatgaaagatgcatgcctctttggctctttgaacatttagcaagtattgggaattttctattagcagtggtgttttaattggttgaattccacttagttctccacagtgttttgtatgtgtttggggcttggtgattattttgaaagatacattttttaaagaattaggaacattttttgcaaaatgctaatcagaatataattttcccaatgtcaggtatagaagttatcccattcttctttacctggtctccttccttcgtctagaaccttccccacagtagctaatcctaacaactttttatttatgttctttgataataatagctcatcccgctcatgattatagctacccacaaaaaataaaacaacaacaac

SEQ ID NO: 28183 - DNA, 1678 bp, Homo sapiens
gatgacaagggcaaaggcgttagaagtcaccaccgacccagcccctcaacagcaagttggttcttcagcattaagatccaggtgtcagcctatgtctttatattgtcaagatgtctctttctaagaagttgactttagacaaactggatgttagagggaagcgagtcatcatgagagtagacttcaatgttcccatgaagaagaaccagattacaaacaaccagaggatcaaggcttccatcccaagcatcaagtactgcctggacaatggagccaaggcagtagttcttatgagtcatctaggtcggcctgatggtgttcccatgcctgacaaatattccttagcacctgttgctgttgagctcaaatccttgctgggcaaggatgttctgttcctgaaggactgtgtaggcgcagaagtggagaaagcctgtgccaacccagctcctggttcagtcatcctgctggagaacctgcgctttcatgtggaggaagaagggaagggccaagatccctctggaaagaagattaaagctgagccagataaaatagaagccttccgagcatcactttccaagctaggggacgtctatgtcaatgatgcttttggcactgcacaccgcgctcatagttccatggtgggagtgaatctgccccataaagcatccggattcttgatgaagaaggaactagattactttgctaaagccttggaaaacccagtgagaccctttctggctatacttggtggagccaaagtggcagacaagatccaacttatcaaaaatatgctggacaaagtcaatgagatgattattggtggtggaatggcttataccttccttaaggtactcaacaacatggagattggtgcttccctgtttgatgaagagggagccaagatcgttaaagatatcatggccaaagcacaaaagaatggtgtaaggattacttttcctgttgattttgttactggggacaagtttgacgagaacgctcaggttggaaaagccactgtagcatctggcatatctcctggctggatgggtttggactgtggtcctgagagcaacaagaatcatgctcaagttgtggctcaagcaaggctaattgtttggaatgggccgttaggagtatttgaatgggatgcctttgctaagggaaccaaagccctcatggatgaaattgtgaaagccacttccaagggctgcatcactgttatagggggtggagacactgctacttgctgtgccaaatggaacactgaagataaagtcagccatgtcagcactggaggcggtgccagtctagagcttctggaaggtaaaatccttcctggagtagaggccctcagcaacatgtagttaatatagtgttacttccttctgttttctgtccatggcccttaagtcagcttaatgcttttacatctcgatgtgacttttgttaaaatctactcctagatcaagacctatgtaatggacaagcagcaggccatcaggaactcttaatatcagcacagcaattcattttagtttggtcacgcatttgcctgttcaagttctcatttgaacttcaccattgtgctatctagggaggacatattcttaagttgcctattaaagaaagtgagctgaagaaactgaaaaaaaaaaaaaaaaaaaaaaaaaaaaaaaaa

SEQ ID NO: 28184 - DNA, 2597 bp, Homo sapiens
cattgtctccgcggcggctgcagccctcgagcgcccgccgcgcgcgcgcgcgcaaccccggccgccgcccgcgctcccgccccggcctcgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctgaaaaaaaaaaaaaaa

SEQ ID NO: 28185 - DNA, 3885 bp, Homo sapiens
catctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacagcccagcacggccgctcagtacctgcagcagatgtacgccgcccagcagcagcacctcatgctgcagaccgcggcgctccagcagcagcacctcagcagcgcccagctccagagcctggcagccgtacagcaggcaagcctggtatccaatagacaaggaagcacttcaggcagcaatgtgtctgcgcaggccccggcccagtcatcttcgatcaacctggcagcctccccagcagcagcccagctcctcaaccgggcccagagtgtgaactctgcagcagcctcaggcatcgctcagcaggctgtgctcttgggcaacacgtcttccccagccctgactgcaagccaagcacagatgtatctgagggcacagatgctcatcttcacgcccacggccaccgtcgctactgtgcagcctgagctcggcactggctcccccgcccggccccccacccccgcccaggtacagaacttgaccctccgaacacagcagacaccagcggcagcagcctcgggccccacccccactcagcctgtcctgcccagcttggccctgaaacccacgccgggcggtagccagcctctgcctaccccagcacagagcagaaatactgctcaggcttcccctgcaggtgccaagcctggcatagctgacagtgtgatggagccacacaagaaaggagatggcaacagcagtgtgccagggagcatggaaggccgggctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccaccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctgaaaaaaaaaaaaaaa

SEQ ID NO: 28186 - DNA, 1537 bp, Homo sapiens
cggacccggaagtgcttggccacagtcgcagccccggcgccccgaagcgggaaaaaggctgggtgccgccgtcccccagctgcgcaaccctaggaactctcgggttcacagtctctctttttctaggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggtctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatccaaaaaaaaaaaaaaaaaaaaaaaaaaaaaaaaaaaaaa

SEQ ID NO: 28187 - DNA, 1514 bp, Homo sapiens
cggacccggaagtgcttggccacagtcgcagccccggcgccccgaagcgggaaaaaggctgggtgccgccgtcccccagctgcgcaaccctaggaactctcgggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggtctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatccaaaaaaaaaaaaaaaaaaaaaaaaaaaaaaaaaaaaaa

SEQ ID NO: 28188 - DNA, 5621 bp, Homo sapiens
gtggctggagtccgggcagagcttgagggcagttggtgcggtcgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtatggctcaatcacaaaggagtgagacagaaacgcctgaatgtctggctgggaattaagaatgaggatgctgctgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtattttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgcttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaaaaaaaaaaaaaaa

SEQ ID NO: 28189 - DNA, 3313 bp, Homo sapiens
gagctcctttgagagttgtggaccagtcagacacaaaattatctttaaatatacagatagggatgaggaagccaaggcccagcagagctgagatgtgactgcagagccgtccaaccccagtcctgtgacctttctctggtgcctgatacctctcagcatttgagggcctttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagacacaagtgaaaaaccaaatcctgtctcgtttacccaagattccgtgtacattcattcaagcatggaccaacacagagatgattacgttgctagcctgttattacttcagatcagtttcaactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttacgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacaggttcaagatggcaacatcagagcattaaactaagcaagcagtcctgtgtgtggctcacacctgtaatcccagcactttgcgaggccgaggcagactgatctcttgagtccggaagttcaagaccagcctgggcaatatgctcaatccatctgagcacctgttattcatatcagaaggaaatgaaatcaatagcattttcttccccagtggcagtctttaaacttccttctcttttgccagatgagaaggttcagcctagttcttcagtggttccatacttaaaccatccaaaaatacagaaaaacatcaagcaacccaaatcatgtgggacattctgcagtatacctgatgagtactcttcagaactgtcaaggtcatcaaaaacaagaagtctaaaaaaccatcacagtctatgagagcctaaggagatgtgacacctaaatgtcacatggtatccagagtgggactctggaacggaaaaaggcattaaggaaaatgaacaaaatctggatatagtatggagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagatttttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttcccaaaaaaaaaaaaaaaa

SEQ ID NO: 28190 - DNA, 2764 bp, Homo sapiens
cggccactgtaaacagcaagcagttgacgggaagactagctctgttgctactaagcagcttttacttttgtaaagtcagctctgttgttttaaatggtaaaaattaaactaatgaacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagttctcgcaccagaattatccacagcaactgctgagccccactacatacagagaaactatcaacctgacttaagagttttcaagatgtcaaacttaaggctgatcagcagatgggatgtgaaaaatactccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacattggtaaattaagtataaattcttttgcaaaattatagttcatatgtcattgaaagttaaattggttcattaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctca

SEQ ID NO: 28191 - DNA, 3416 bp, Homo sapiens
ctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatacgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacattactatttattttgttttggaactgggacatgattctatttgttataaaataaaattgatgtgattgtcaccttaaaaaaaaaaa

SEQ ID NO: 28192 - DNA, 2205 bp, Homo sapiens
gggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggccagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagatggcaccacaaccaagtacaaaatgagattctctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtcttaatatgagacatactgttactaaacataagttcaaataaaaagttgttctgaaaaaaaaaaaaaaaaaa

SEQ ID NO: 28193 - DNA, 2075 bp, Homo sapiens
ctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 28194 - DNA, 3475 bp, Homo sapiens
ctcggccggggcgtgggctccggctgcagctccggtctgctctcttggctcgggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaactgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggaaggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccatatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaaggttaaaaaaaaaaaaaaaaaa

SEQ ID NO: 28195 - DNA, 3206 bp, Homo sapiens
gtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacagttctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacgttgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttgaaaatatgacattttatgtagcactatataaaaagtgaaagcgacaaattccaccgctgcttaatactgctttgcttctttttattgacatgatagatacatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcatttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctagatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagt

SEQ ID NO: 28196 - DNA, 4074 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggtttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttact

SEQ ID NO: 28197 - DNA, 3150 bp, Homo sapiens
cccgcaggctcggtgaatcgaacgttgagcagggcggtgggtggtgtggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcaagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcggatgtcacagggggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggaattctttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggcccacgctgggaggacacgggctgggctgagcagggcctctagtggaacacattgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggaagcctcaagcaagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactgcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgtaaaaaaaaaaaaaaaaaaaaaaaaaa

SEQ ID NO: 28198 - DNA, 2873 bp, Homo sapiens
tgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaa

SEQ ID NO: 28199 - DNA, 2712 bp, Homo sapiens
tgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaa

SEQ ID NO: 28200 - DNA, 2789 bp, Homo sapiens
tgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaaattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaa

SEQ ID NO: 28201 - DNA, 2544 bp, Homo sapiens
tgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaa

SEQ ID NO: 28202 - DNA, 2687 bp, Homo sapiens
tgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaa

SEQ ID NO: 28203 - DNA, 1760 bp, Homo sapiens
aaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacgtggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataataggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttttaaaaaaaaaaaaaaaa

SEQ ID NO: 28204 - DNA, 2590 bp, Homo sapiens
cttccagtttcccggcgtgcttagggcgcgccaaatgggagggggagacgcaagatggcggcagccgcgaactccggctctagcctcccgctgttcgactgcccaacctggtgagtggcggggcggccagggctagagtggcccggccggagctagcctgggctggaagggcggctctttttttacttttctgctgcgagccgaacggctcagaaaccccggaatggttgaggaaaaactgtttgctgcaccgggccgggcgacgtgttgaagaaccgagagcctggagcccaggcccaggaactgaagaaacccggggttgggggctcaaaggcgctcacttaggcagcccctttgagcgattagccagtcgccggagcgcttcgaggccttggcccgaacttacgcccaactcttgactgagtgcctggtgctctcgtggagcatcgcatctggccccttcctgtacgtcccgagcgcgctcgagccagccccggccccaaccctacctccaagccccgcatccctctgtggttgctgcatccctcgtgcggcacttgtctgtctgccacagagaatacgaggggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtaaacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtg

SEQ ID NO: 28205 - DNA, 2336 bp, Homo sapiens
cttccagtttcccggcgtgcttagggcgcgccaaatgggagggggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtg

SEQ ID NO: 28206 - DNA, 2691 bp, Homo sapiens
cttccagtttcccggcgtgcttagggcgcgccaaatgggagggggagacgcaagatggcggcagccgcgaactccggctctagcctcccgctgttcgactgcccaacctggtgagtggcggggcggccagggctagagtggcccggccggagctagcctgggctggaagggcggctctttttttacttttctgctgcgagccgaacggctcagaaaccccggaatggttgaggaaaaactgtttgctgcaccgggccgggcgacgtgttgaagaaccgagagcctggagcccaggcccaggaactgaagaaacccggggttgggggctcaaaggcgctcacttaggcagcccctttgagcgattagccagtcgccggagcgcttcgaggccttggcccgaacttacgcccaactcttgactgagtgcctggtgctctcgtggagcatcgcatctggccccttcctggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtg

SEQ ID NO: 28207 - DNA, 3401 bp, Homo sapiens
gggtacgagccccgcccgagctcaccgcccctgctcccctctccgaccctttgagccgtggccgttgccagatgtccacaatgggaaacgaggccagttacccggcggagatgtgctcccactttgacaatgatgaaattaaaaggctgggcaggaggtttaagaagttggacttggacaaatcagggtctctgagcgtggaggagttcatgtccctgccggagctgcgccacaacccgttggtgcggcgagtgatcgacgtcttcgacaccgacggtgatggagaagtggacttcaaggaattcatcctggggacctcccagttcagcgtcaagggcgacgaggagcagaagttgaggtttgcgttcagcatttacgacatggataaagatggctacatttccaacggggagctcttccaggtgctgaagatgatggtgggcaacaacctgacggactggcagctccagcagctggtcgacaaaaccatcatcatcctggacaaggatggcgatgggaagatatcctttgaggaattcagtgctgtggtcagagacctggagatccacaagaagctggtcctcatcgtatgagcctttttcttacaagcaccacccaacaacttctgctttcttccctatctctttcaagatttgctcaagacgtccaactgtctctctgacttatctggaagtatttctttttgtgaagccatatgtcctaacaggagcttcatcaccaactcagtgctattaattctccttctctgaatgactcagggtaccctatagggggaagagcaagtcaaatgagcatagtggggaaagaaaaggaaatggcttttataaacatcttttactttgttttgattcaaagaccaaactagaactttaaaagttcaaaaataagaaagtatacatttttgctgttatttctcatcattttgtatatgggaggaaatttataatttgcatgggtgttaggtgaactgttttcatttgcttgtgttcagatatcttgccagattgttaacttcctattgtagcaacagggacaaatatatttgtctttgctgggcatctcgtaatcacttttcttaggggacagaatcccatcttttccttcggcagattgcagccccattccccacaatgcatccagaaatcgctgtgcatgtttgaggggtaggagttcatttggcctcctcctgacttgttgctccagctcctgaacagaaactagcttcagggctcttataggaaatgctaagcctggactaagtgcccagctcagccatcatcctcattagcagtgggtttccagggttggcagcccacaccagcattaatttcaatgaaggggacctccagctaaatagggcaagcaaagtgttctcccagaaagtgctctcacctccgacactggtccctacccccaggtggagacaatgagacatttagttagttgtcctacggaggagaggcagtagagtcaggctgcagtggaatctccctaggatgccaaagtggcattatgtctgttgctcacagatgcagagactgacaattgtgtctccacagcagaggtggatgctagctacaccagctatgctgattttgaaaatcagatctgaggcctagaagagaaactgagagctctctcattccaggaagccttttccctagtggaacattcagtgcagaagtcctcacacactaacagatctccaccattgggtgagccggagcctgtggttccaggggagatccagaatgcatgtgtctcttcccacgcatttatgtcatgttggtagctttagatcagccatggtgagaaaagaacaaaagcttttagttgtttttgttttgttttggagaatttgtttaccagtaaatacatcactgcctgtaccccaaatgttaccagctccctgaggtgtcccacatactattgtgagttctcagagcatgaactgtcctcagaagagcagggctaggacttgtcccagcatctgtgcctccataccaatcctctttctcacagagaaccacttcccatataagatgcttaaggctctcaaaacagcagaacaatgaaacatactctccctacacttgcttagccaagagataccactcaggtaacttttttcaggacatggaagatctgtttcaaggagatttactgctattttatttggaagaagctggcaactggtcttgaccaaaatagaaaaaaaaaaaaaaagtccacaaatttaatcacttgtagggaacccatctatcaaggtaccctaccatatacttttgtatttaatagattacttagaaaccacaaaaataggaatccttaccccttcaattcctgttcaaccctaaaaactgtgataaacgctcccaaccctgtggtgatcagggttatgtaatgttcaaagattcagacacacctgggtttggattcagttgcaactgggttgttatcacactcacttctttttagctgtgtgagcatgaataatttacttagcctctctgtgtctttccacctaattaaagaggatccaccccagggttattttgaggattcaaaaaggcatgcaacacacctggagcacaattccactttcattcaactaattcccttcccttcccccttcttccccttctacaagatcaatatgtaaaggagacatgaggcttactggttgcttttgaacacttacttagttcttagctacacccactctaaaattaactggacattagtgtacagcccatgtccaagcccagagagaaaacaatgggaacaatttcaaggtcctcaccactccttcatttgcagaggggacaacagactttctgaccagagaactggagaatttttaaaacaaaatctctcattccagcccaacctatttaactttttgtggaggaattttacatggaggaagtgagcacatgtcatgctagccaagaggacattattgtcattaaagagaggcattatttatacaccctgcaatgtgcacattaaaatatggaaattttaaaattatgaccaagggcttgaaacatattggattacatgctcacatttaacaaagagaggaaatgtgtttcagtttctggagtggctggaatttacaagctaattgttcaataaatctactcaagatagttacctaaggctttgtggcaatgaccttgaactgagagcctgtatctggatttagcacttgaaagatctaactggatatttgggttaaaagaatcacatttattcccaaatcggaatgctttgtttttcctgtcagttaattgccagttgccaacaaatctagttctatacagtttcttgggatgatgataataaacatttattgagcaaaaaaaaaaaaaaaa

SEQ ID NO: 28208 - DNA, 3878 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtaaaaaaaaaaaaaaagaaaactcgaggagggcccgggcc

SEQ ID NO: 28209 - DNA, 2162 bp, Homo sapiens
cgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaaaa

SEQ ID NO: 28210 - DNA, 2776 bp, Homo sapiens
cgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacgtaagttcgagccctgattcctccgcttccccgcagggtgaccttgggcttgtgcccccggcaccacccctgtcccgggtccctgttttctctctggaaatgggttgaagaccaaagaaaataatgtgcgccacttgggtcaccccgggccgcctgccccggaaaattggccccagttgaggagttgtggctgtaaggatgccttgaaccgaggcggcggtgctcgtggttggagctctccagggtgggtgcgcatttgtaatgcggtggatgctctgggactcggcccctctgaaggtgctgggggttggggacggcccaggcagtggcgtaggcgtcctaggaaggcgggagcagaggcagaaatgtcgctgcaagaccgtagtcagggtccttgaccacaggggtcacttgtgaccaaccacatggtctgttgttcctcctgccccctggttcagcccaggaaacactggtgctcaggtttggagccagagatttgcactgaaagggcgggattgagtcgccagttgtcagtttcctcagcagtatttgcggaggttttcacaggaggccgttgcttcgtaaatattatacatgtattcttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaaaa

SEQ ID NO: 28211 - DNA, 2141 bp, Homo sapiens
cgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaaaa

SEQ ID NO: 28212 - DNA, 2220 bp, Homo sapiens
aatgtagggaaagcagggcggagtcctctgcaggctcgggggaggggaggggcgtgaatgcgtggatttctgtggagagtggaaacacggggagtcgaggggagcatgcgcgggcctcagaaagttctgggaaaccgactcctgggagcagggaggaacgcgcgctccagagacaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaaaa

SEQ ID NO: 28213 - DNA, 2197 bp, Homo sapiens
aatgtagggaaagcagggcggagtcctctgcaggctcgggggaggggaggggcgtgaatgcgtggatttctgtggagagtggaaacacggggagtcgaggggagcatgcgcgggcctcagaaagttctgggaaaccgactcctgggagcagggaggaacgcgcgctccagagacaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaa

SEQ ID NO: 28214 - DNA, 2104 bp, Homo sapiens
gatttgttttcttgcagatttatgaggatgagcctacaggccccacgcagactcctggagctggcagggcagagcctgctgggggaccaggccttggccatctccatcttggatgagctgcccagggagctcttccccccactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggcggaaacttcaagtgctggaattgcgggatgttgatgagaatttttggaccatatggtctggagccaggcccctgtcctgctccccagaggccatgagtaagaggcagacagtggaggactgtccaaggacaggagagaagcagcccttgaaggtgttcatggatgtttgcctcaaggaaaaattcatggatgaagatctgagcttcttctctgggtgggtccagcacagaagaggttcagtacacctgtgctgtactaaggtggtgaattattcaatgagcattctaaatttcagaaacatattggaaacagtatacccagacagtatccaagtgttggaaatttggaacatgtgctggccgtgtatgatagtagagtttatccgttacctgagccagatgaggaatcttcgcaaactcttcatctccgatggctgtcgttacctgctaagctctgacagccaagaacagttagttgctgaattcagctctgtgctcctcaggctggagtacctccagatgctttatgtaagaagggtctgcttcttcagaggccacctggaccagctgatcaggtgcctcaggagcccattggagacattggcattaacttatggcttcctagaaaaagtggacttgaaatgtctgccccggtacccaagtctcagtcaactgaagcagctgaatctgagtcatggtgcactgcgcttcatccgtcttgagcccctccgagctctgctagagaaagttgctgccactcttcagaccctcttcttagtggactgtgggattcgggactccaaactcagggtcatcctgcctgccctgagctgctgctccaacctcaccactttctgttttcacggcaatgacacgtccatggatggtctgaaggacctgctgcgccacacaggcaggctgagcaatttgagcctggaaacatatcctgcccctcgggagagtcttgatgacaggggtcgtgtcatttcggagctcctcaccccacttcaggctgagctgatgcgtatactgagggaagtaagggagcccaaaaggatcttctttggtccggtgtcctgcccttgctgtggcacgtcgcccactgagcaactggagttcaatttttgcttgtggggaaggcctgcctagtggggtggaggtataaaaagctttttctccaggcacttggaaactaaaatctgggacatagatgtcttttatttttctttttccttattttacaattttacagtttttatttaaaaatttgagacagggtttccctatgttgtccaggctggtctcaaactcttacgcttaagggagccacctgcttggcctcccaagattctgggattacaggcataagcagctgtgccgggtctataggtgtattataaagggagcagagaaacctctgtttcaggcatgtgctttctgtgagtgggaaaaaaaacacaaaaaaacccagcagggggcagcactggggaaaaggttgaatggagtcactgagactcagggatctgtgtcctagacagtcagaaatagaaagctgaagttctagagtgaaggagttatctcagcaaggatggatacaaagaaacgtcggaagtagagggaacctaaatggaaactctctgctgtccttcatgattgattagcctgtttcagcaatttatacatcagaaatctttagttcctgatgaattaaaaaaagaggtactagttcatctgtgatttaggttcatctgcaggaaataaaggaatcaaaataaacttcattttg

SEQ ID NO: 28215 - DNA, 2381 bp, Homo sapiens
gcccgtcggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcct

SEQ ID NO: 28216 - DNA, 406 bp, Homo sapiens
ccctctcagctgcccacagagttccacctgctgacaggttggctggctcagccaaggtggtgccctgctctgagcattcaggccaagcccatcctgcaccatggccaggtacagatgctgtcgcagccagagccggagcagatattaccgccagagacaaagaagtcgcagacgaaggaggcggagctgccagacacggaggagagccatgaggtgctgccgccccaggtacagaccgagatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtc

SEQ ID NO: 28217 - DNA, 683 bp, Homo sapiens
agaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaacgagcaaaagtcacctgcccaataaagcttgacaagacactc

SEQ ID NO: 28218 - DNA, 4047 bp, Homo sapiens
gggtgtgctgggggactgtgcagctcgaggctccagaggcacactccagagagagccaaggttctgacgcgatgaggaagcacctgagctggtggtggctggccactgtctgcatgctgctcttcagccacctctctgcggtccagacgaggggcatcaagcacagaatcaagtggaaccggaaggccctgcccagcactgcccagatcactgaggcccaggtggctgagaaccgcccgggagccttcatcaagcaaggccgcaagctcgacattgacttcggagccgagggcaacaggtactacgaggccaactactggcagttccccgatggcatccactacaacggctgctctgaggctaatgtgaccaaggaggcatttgtcaccggctgcatcaatgccacccaggcggcgaaccagggggagttccagaagccagacaacaagctccaccagcaggtgctctggcggctggtccaggagctctgctccctcaagcattgcgagttttggttggagaggggcgcaggacttcgggtcaccatgcaccagccagtgctcctctgccttctggctttgatctggctcacggtgaaataagcttgccaggaggctggcagtacagagtgcagcagcgagcaaatcctggcaagtgacccagctcttctcccccaaacccacgcgtgttctgaaggtgcccaggagcggcgatgcactcgcactgcaaatgccgctcccacgtatgcgccctggtatgtgcctgcgttctgatagatgggggactgtggcttctccgtcactccattctcagcccctagcagagcgtctggcacactagattagtagtaaatgcttgatgagaagaacacatcaggcactgcgccacctgcttcacagtacttcccaacaactcttagaggtaggtgtattcccgttttacagataaggaaactgaggcccagagagctgaagtactgcacccagcatcaccagctagaaagtggcagagccaggattcaaccctggcttgtctaaccccaggttttctgctctgtccaattccagagctgtctggtgatcactttatgtctcacagggacccacatccaaacatgtatctctaatgaaattgtgaaagctccatgtttagaaataaatgaaaacacctgagctggtggctgtgtactttgactggtacatggaggctattttaatccttctaactaaactaaaatagattaaaggaattaaactaaaatacaagtaaagctagacaaaggcccagaaatcatactgtaaggaaatgttattggaagctgattcccagagcagaccacatatacagcaggatgtgcctgtggcatgaagattttctttctcttttttttttttttttagatggagttttactcttgttgcccaggctggagtgcaacggcatgattttggctcactgcagcctctgcctcccaggctcaagcacttttcctgtctcagccttccgagtagctgggattacaggtgtgtgccatcatgcctgactaattttgtatttttagtagagacagggtttcaccatgttggccaggctggtcttgaactcctgacctcaggtgatccacccacctgggcctcccatagtgctgggattcaattttttttttttttttttcaaaagaagggtaagtgcttgctgttcccatccctgaaacattgcatgtatttaagaaaaacaaaatgttagtggcatatttgcttctaatgttcccctaaccctacatgcatgttttatgtgcactcatatgagtatctttaaatataatccctttacatctgtgttctatgcaaagtctctcatttctttcaagacagcctaatgaaggccatcatctctgtaaaccacttgtcactacaaaaatacaattactcaccaaaaagctttaaaaaataaagctgtgtctttagggagacccaataaagaatgcaatccatgccataagcaggagttgatacaccaccttattagctaaaaatatatataacacaatatgagtaatgtttaagatctgttttaaatttaaaacaatgaattgaatgctctaagaggctcctacaggcgctccaggccactctcagagactcccaggagttgttgaactatatttggagaaaacagccactgaatattatcatttctcctttaaagagagtttgtaaggggggaacatgcattttatcagacaatttatccaaagcattgcagaacatgagtgctgatgagggcacctcttgtgctgagtcccctcagctatcagtgttcttctcaaggacacatttggaaggttttaacattgaaagtgagcggaggacttgggggcagagcagcacaaagaaacagccttacactgggcacatggaggagacgtccaccctgcagccaggactggggttcacgtcactgccagagctacactcgccttctgcttccacggtcctgttaattctagatcagagagcaagaaaaaagtacagaacatatcctctacggttatttcctgctttctaattaaaaaaataataaccatggcaagagagaaagaaagagaaagtactcagaggctgacactgacatttcacttcctcgctctcctaagtttaattacaacagcacgtgcagccacgtcagccaaatgacttcatttctgatgtgaaaacgcttaggccatgatgtcgttcattttctgtaattgctgccttttctcattctgttaatagtcccggcaaccagatttcagtggggcatgacgtgaatgtgtatatggtgattcaaatgcaaaatttgtttatggggcttttaatcgaacgcgtgtgtgcctgaacattcttgctcaagttgatgaatcatggggtggaataaaggctgagtttagtttttcactttagcaaaggggcaatggggtgcctactatgtgcgagacattgggaggggcttctgaattattctggatatcgtcattttgcagtgtgcataattttgccaaccgttgctttcgtagcccctgctaagtgttgactttttaaaatataagtttattgtaaaagtgacatgaaaattacaacagatattccagaccaaaataatacaacaatcccagcatctgattgagtcagtgtttgctgtttcccctgcactttcctagttcttaagcatttgcgtatgtaaacattcatatttgcaataaaaaagtgagcttttatattctaaatttttacttaacttaattcaatgctttctactcatttttctatacttttttttttgaggcagagtctcattctgttgcccaggctggagtgcagtggcgtgatcttggctcactacaacctccaccttccaggcttaagcgattctcatgcctcatcctcccaagtaggtgggattacaggtgcccaccaccaagccctgcaaatttttttgtatttttagtagagacagtgttttgccatgttggccaggctggtctcgaactcctgacatcaggtgatccacctgcctcggcctcccaaagtgctgggattacaggtgtgagccaccacgccctgcctactctttgttttctttcctccccacccattttcccccgtcctgtcccctccttccagcctgagatgtaggctccaccttaactgtgctcagatacacaagtgagggctttttaacttgattatgccttttaaaaatactatgtatgtaaaatatttattcatctgcaatttggcttccctaacttaacattgcatcatgaaactctttggaacaacagctatctagatagctgactcattcttttggattgctacgtaatctcacttaatacagatgtatcatgattgattgaatcattgccttgttgatgggccttcagattatttccagttttttgccactgcaaacaataaacatccttgtacatactaaaaaaaaaaaaaaaaaaaaaaaaaaaaaaaaaaaaaaaaaaaaaaaaaaaaaaaaaaaaaaaaaaaa

SEQ ID NO: 28219 - DNA, 2048 bp, Homo sapiens
tcccggaaatggtctaagccccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaacgaaaaaaaaa

SEQ ID NO: 28220 - DNA, 2205 bp, Homo sapiens
tcccggaaatggtctaagccccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaacgaaaaaaaaaaaa

SEQ ID NO: 28221 - DNA, 1263 bp, Homo sapiens
ggggagactacgcagcctggagccgggctggggaggccggcgggggctgcgccagcatgaggcggggttaggggctaggcgggggcgaagccgagactggagttcacggctgggccgagggctcggccgggctgaggctcagggttggacttcacgcaagagtcctgtagagacgaagacctgggcggagagcgatgtgggtcaggacgacgctcacaattgaaagatggactaaggaaaagaccgagcccaaggcccgctcgtgggatgagagcagatgccgcggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaagaaaaaggaaaaagagaaagacaaggaggagatggatgagaaggcaaagctgaagaaaaaagccaagaaaggccagttgactaagaagaaaagcccggttaaattggagccttccccgccagacgtgagccgatcattaagcgcaagacagctggccaggatgtccgagtccagcccagaaagccgggaagagctggagagcgaggacagttacaatggccgggggcagggagaactgtccagcgaggatattgtggaatcatcatcgcccaggaagagagagaacacagtccaggccaaaaagacaggggcaaagccctcacaagccaggaaggtaaacaagagaaaatctcccccaggatcaaaccccaacctcagttgaggccagggtggtcagggtgcagaataaatgccatcgagcctgaaaaaaaaaaaaaaaa

SEQ ID NO: 28222 - DNA, 1372 bp, Homo sapiens
gaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaggagggcagtcctctgtccagattggggtgggagcaagggacagggagcagggcaggggctgaaaggggcactgattcagaccagggaggcaactacacaccaacctgctggctttagaataaaagcaccaactgaa

SEQ ID NO: 28223 - DNA, 1827 bp, Homo sapiens
gaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggtaccaatatagttgttcttggggtagaaaaaaaatctgttgccaagcttcaagatgaaagaactgtgaggaaaatttgtgcccttgatgaccatgtctgcatggcttttgcaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattcaaaaaaaaaaaaaaaa

SEQ ID NO: 28224 - DNA, 1713 bp, Homo sapiens
gaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattcaaaaaaaaaaaaaaaa

SEQ ID NO: 28225 - DNA, 1829 bp, Homo sapiens
gaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggtaccaatatagttgttcttggggtagaaaaaaaatctgttgccaagcttcaagatgaaagaactgtgaggaaaatttgtgcccttgatgaccatgtctgcatggcttttgcagttttgacaatttttataggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 28226 - DNA, 861 bp, Homo sapiens
caggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccaaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaatgtttccctcaaggacctttctgcctggaagtctgttagcctttcagaagtaacatgtccaaaataaaatttgattcctcccaggttgttccctgcctggtccgc

SEQ ID NO: 28227 - DNA, 3615 bp, Homo sapiens
agtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaaaaaaaaaaaaaa

SEQ ID NO: 28228 - DNA, 728 bp, Homo sapiens
gcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattcttcaacagaaaaaaaaaaaaaaaaa

SEQ ID NO: 28229 - DNA, 2352 bp, Homo sapiens
gccattaccaatcgcgaaaccgcgccggcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggtt

SEQ ID NO: 28230 - DNA, 1954 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttccttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttaaaaaaaaaaaaaaaaaaaaa

SEQ ID NO: 28231 - DNA, 4606 bp, Homo sapiens
gacagagcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggtctgtgtaagactaccttcctcttagatgccgtcagaaatagaagagcaggttatgaggtgagacaaatggctgccgcactgctacgacggcttttgtcctctgggtttgaggaggtttatccaaatctgcctgctgatgttcagagagatgtcaagattgaactgattctggctgttaagttagaaacacatgctagcatgaggaaaaaactttgtgatatttttgcagtgctggccaggaatttgatagatgaggatggcactaaccactggccggaaggtctgaagtttcttattgattcaatctactccaaaaatgtggttctatgggaagttgcacttcacgttttctggcactttcctgggatttttgggacccaagagcggcatgatttggatatcatcaaacggttgttggaccagtgtattcaagatcaagaacatccagcaatcaggacattatccgctagagctgcagctgcatttgtacttgctaatgagaataatattgctcttttcaaagactttgcagacttgcttcctggaatcttacaggctgtgaatgactcatgctaccaggatgatgattcagtgctagaatcccttgttgagattgcagataccgtacctaagtacttgggtccttatttagaagatactctacagttgagtttgaagttatgtggagactctaggcttagtaatctgcagcgccagctggccctcgaagttatagtgaccttgtctgaaactgccactccgatgttgaaaaaacatacaaatattattgcacaggcagttcctcatatattagcaatgatggttgatctacaagatgatgaggactgggtaaatgctgatgaaatggaagaagatgattttgacagcaatgcagttgctgcggagagtgcactagacagactggcttgtgggcttggtggaaaagttgttttaccaatgaccaaggagcatatcatgcagatgcttcagagccctgactggaagtatcgacatgctggattaatggccttatctgccattggagaaggatgccatcaacaaatggaatcaattctagatgaaacagttaactccgttttgctttttcttcaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagctaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggtttgtggaatatacagaacaagttgtgaagctgatggttcctttactgaaattttatttccatgacaatgttcgagtggcagcagcagagtccatgccttttctcctggaatgtgcaagaattcgtggcccagagtatcttgcacagatgtggcaattcatatgtgaccccttaatcaaggctattggtactgaaccagatacagatgtgctctcagaaataatgaattcttttgcaaagtccattgaagttatgggagatggttgccttaatgatgaacacttggaagaactgggaggaatactgaaagcaaaacttgaagggcactttaaaaaccaagaattgagacaggtgaaaagacaggaagaaaactatgatcaacaggttgagatgtctctgcaagatgaggatgaatgtgatgtttatattctgaccaaagtatcagatattttgcactcattatttagtacttataaggaaaagattttaccatggtttgaacaactacttccattaattgtaaatctaatttgttcaagtaggccatggccagacagacagtggggattgtgcatatttgatgacatcatagagcactgcagtccaacttcatttaaatatgtagaatattttcggtggccaatgctactaaatatgcgagataacaaccctgaagtcaggcaagctgctgcttatggcctgggtgtcatggcacagtttggtggagatgattatcgttctttatgttcagaagctgttccacttctggtaaaagttattaagtgtgcaaattccaaaaccaaaaaaaatgtcattgctacagagaactgtatctcagcaatagggaagattttgaagtttaagcctaactgtgtaaatgtagatgaagttcttccacactggttatcatggcttccactgcatgaagataaagaggaagctattcagactttgagttttctctgtgacctaattgaaagtaaccacccagttgtaattggtccaaataattccaatcttcccaaaataatcagtataattgcagaaggaaaaattaatgagactattaactatgaggatccttgtgccaaacgcctagctaatgtcgtgcgtcaggtacagacttctgaagatttatggttggaatgtgtatcacaacttgatgatgaacagcaggaagccttacaggagttgctaaattttgcttgaagcactttaatataacttgaatattatctattataaaagtaactacaaataagtgttgtgaatagattttattataaatcagagaactgttttctccctgctaagcagtttatagttcttctccatgtttctccagaattaatcagtgttagtcctctgtttatctcgcatgttttatcttccaaacacagaccttggtgataacctgtgcttcaaactgtcttaaacaatgtttgtcacctttcccctagttgatgtaaagtatataaattgttgctatttgtttgaactattattgatgctagccaagcagtatacttgatgtgaagatgtcatgctatcacaatatgctaagagctcacaaaaataagatagaatttccaggacaaacatctttggaattgtgagtgaaggatatagtggcaggcttgtccctctttaattaatactcttggtatttgtggtgatgggaggatgctgttactaggagagttttgagatactgcagtggatgtgggatgtatatgaacttcttcataatgtactcctgggaactgggtaggacatatccatattgtagttcccaaggtgtctggttgagagttagagaacttttaaatttctttagccagacaggtctctatttttttaagttatccaggactccaagaaccatagttactgaaaagggagtcctgatacatctaatattggtagcatgtaacagtgtttgacaaagagtaagtaagcagtattcttgggagtcagtgttatgtgtttcagcagagtattattttgtatatgtatgccattttctccctgcaaagcagctcaacaagagaaaaagctctagttatagggcttaaattgatttctatttcaaataatttcctaagagattctagagtagaactgaagagtattctattggaaaagtgaaaggaaagaaatgtaattttctttgaacatgaaaaagaaaacaactttgagagtagtcatttagcagtagatgtgcattattatgagaaaacagttctataagtccagggttaattatattaattggaatgtcagtctttaatgtcgagcttattgtagggtagaaaagagctttctactcagctaacgattactcattgatccaaaacttaaatacatctataatttcctggggctattgtgagtactgtgtatgtatttagcaaatatttaagacctagtaagtgctcaataaattgtagctgttattgctgttgttgtttgtacctctaaaaaaa

SEQ ID NO: 28232 - DNA, 2690 bp, Homo sapiens
taaaagctgcttcctgttggggcatgagtccggcgcgtgtcgggttttgagctgccgcggtcccgggactgagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaaaaaaaaa

SEQ ID NO: 28233 - DNA, 2774 bp, Homo sapiens
taaaagctgcttcctgttggggcatgagtccggcgcgtgtcgggttttgagctgccgcggtcccgggactgagctccttgggagcagacagctgtcctcactggcagaggaggagcgctcagtaaatgctcgctggacgaataaatggctagataagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaaaaaaaaa

SEQ ID NO: 28234 - DNA, 4577 bp, Homo sapiens
tccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagccctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggatttta

SEQ ID NO: 28235 - DNA, 4015 bp, Homo sapiens
gggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgcttgaaatggcgattgaaaacctccaaaaaagcgaaggaatcacatcacacaaaagcggtttactcaacagccatctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaaattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgcctta

SEQ ID NO: 28236 - DNA, 3940 bp, Homo sapiens
gggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaaattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgcctta

SEQ ID NO: 28237 - DNA, 6251 bp, Homo sapiens
atttatattcattttttactcttttccatcaaaacataattttactaagtacgcatgttctgtgtccgtgttttgtcatcactgaagccacttttggagtcacctagtaatagcctttccactctatctagttctgtagcttttatgtgtgtaaattacttcaaatctgtttatgatcctattgctggaaactttatcccaagacacaaaaatcttttctattagaagttattaactttaaaacaattatttattttattttattttattttttgagacagagtctcgctttgtcacccaggctggagtgcagtggcacgatctcggctcactgcaagctccacctcccgagttcatgccattctcctgcctcagcctcccgagtagctgggactacgggcgtccgccaccatgcccagctaattttttttgtatttttggtagagacaaggtttcaccgtgttagccaggatggtcttgatctcctgacctcgtggtccacctgcctcggcctcccaaagcgctgggattataggcgtgagccaccgcacctggcctaaaacaattatttctttaaaaaaacataccctctattctattttgtgtcttcacaacacaatcacttactgtattgctttttaaagtgatctttaaagagtcttgcagaagagactacacagcaggcccgagaccatcctgagaggcctgtgtgcaaggctggccccccgctgtgtcaggacggtgcccaccaccctcaatgaagaggggctccctgtgcttagctgcttgtgtggggaacaagggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcagagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatcaaaaaaaaaaaaaaaaaa

SEQ ID NO: 28238 - DNA, 2060 bp, Homo sapiens
agatgctcagtccctggtatgatgagtttctagatgaagaggactactggtttctcctttttacgtaactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggtgaatgtccctgagttccagaaggatgccatccttgctgccatcacagagggctacctagatcggagcgtcttccatggggctatcatgtctgtcttccccgttgttatgtacttctggaaaaggttttgtttctggaaggcaacccgctcttacttacagtatagggggaagaagttcaaggacagaaaaagccctcctaaatctacggacaagtatcctttctcgagtggaggagacaatgccatcttaaggttcaccttgctcagaggtattgagtggttgcagcctcaacgggaagcaataagttcagttcaaaattcttcatcaagcaaacttactcagccaagactcgtggtatctgccatgcagctgcatcccgtccagggacaaaaattatcctacatcaaaaaagagaagtaatcaagcgagacccccagcagagataaatcatctcttagaggcctcctaacactgacagaaacttttctggtcaaaaatgaaaggtcctggtaccatcttccccagaaacgatcaagaagggcaatgggttgacagcccagatatggcaggaccagactgcaatgggaatctcatacagcccattcagactaaagggtgatggaaagaagcagaggaaagcagaaacagcaagagtgactgagacctgctgtcatctatatagaagcctttctgatacatgtcagagagtgacatgaagtctcccctctttatacacacgtatgaaaatacatctatccctcattttgagagcctccaactgatccaagtgtcatccggaggaggaggtggcccgtatgtgcaggacctcagggtgccagccctcacccatacacctccagggctgcaggtcattagccagaataaaggatgtccacattcacaa

SEQ ID NO: 28239 - DNA, 3497 bp, Homo sapiens
cggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactg

SEQ ID NO: 28240 - DNA, 3589 bp, Homo sapiens
cggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtgaggagcacattttgttaacattcagatttaattactgtaagtaaaatttaaaatgtaaatacatcagttcatgttctgtattgaaataggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactg

SEQ ID NO: 28241 - DNA, 3493 bp, Homo sapiens
ggccgagctggagctggaagaggacgaggaggagggggaggaagcggagctggacggagacctgctggaggaggaggagctggaggaagcagaggaggaggaccggtcgtcgctgctgctgctgtcgccgcccgcggccaccgcctctcagacccagcagatcccaggcgggtccctggggtctgtgctgctgccagccgccaggttcgatgcccgggaggcggcggccgcggcggcggcggcgggggtgctgtacggaggggacgatgcccagggcatgatggcggcgatgctgtcccacgcctacggccccggcggttgtggggcggcggcggccgccctgaacggggagcaggcggccctgctccggagaaagagcgtcaacaccaccgagtgcgtcccggtgcccagctccgagcacgtcgccgagatcgtcggccgccagggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccatttgaaccagttaacccactctctggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttgataaagacttgtttccattaacttgaaaaaaaaaaaaaaaaaaaaaa

SEQ ID NO: 28242 - DNA, 3398 bp, Homo sapiens
tcgcttttcgctcggcattgcggccagccagccgggcactcggggggcacgcgcggccaccgctagagctctgcccccaccccacccgccagcaggtctggggtggggacccaggtgggggctcctgcagccactgcccggtgcggaccgcacggagcgacccactcctcccagcaccgaggaagaagcaacggagccctcagcgggcgaccggcctccccgcccctgaccacccgcttcccggctgcctttgtggccgcagcttctcgccgccgagccgagggccggcgggggcgcggcgcgcacggccgagcgatgcccagctcgctgttcgcagacctggagcgcaacggcagcggcggcggcggcggcggcagcagcggagggggagagaccctggatgaccaaagagccctgcagctcgcgctcgaccagctctccctgctggggctggacagtgacgagggcgcctctctgtacgacagcgagccgcgcaagaagagcgtgaacatgaccgagtgcgtgccagtacccagttctgagcatgtcgccgagatcgtggggcggcaaggttgtaaaatcaaagcgctgcgggcgaagaccaatacttacatcaagaccccagttcgcggggaggagcctgtctttgttgtgacgggcaggaaggaggatgtggccatggctcggagggagatcatctctgctgccgagcacttctccatgatccgcgcctcccggaataagaacacggcactcaacggcgcggtgcctgggccgcccaacctgcccgggcagaccaccatccaagtgcgggtaccctaccgcgtggtggggctcgtggtggggcccaaaggcgccacaatcaagcgcatccagcagcagacgcacacgtacatcgtgacgcccagccgggataaggagccggtgttcgaggtgaccggcatgccagagaacgtggatcgcgctcgagaggagattgaggcgcacattgctctgcgtaccggcggcatcattgagctcacagacgagaacgacttccacgccaacggcaccgatgtgggcttcgatctgcatcatgggtccggcgggtccggcccaggcagcctctggagcaagcccacccccagcatcacgcccacccccggccgcaagcctttctctagctaccgcaacgacagctccagctcgcttggcagtgcttccacagactcttatttcggcggcgggaccagcagcagcgcagcggctacccagcgcctggcggactacagcccccctagccccgccctgagctttgcgcacaacggaaacaataacaataacggcaatgggtacacctacacagcggggggagaagcctcagtgccatcccccgacggctgccccgagctgcagcccacttttgacccggctcccgctcccccacctggggcaccacttatctgggcccagttcgagcggtccccgggaggcggacctgcagctccggtatcttcttcctgctcttcttctgcatcttcgtctgcttcttcctcctccgtggtcttccccgggggtggcgccagtgcgccctccaacgccaacctggggctattggtgcaccgccggctgcaccctggcaccagctgcccgcgcctgtctccacccttgcacatggccccgggggcgggagagcaccacctggctcgccgggtgcgcagcgacccgggtggaggaggcctggcctacgccgcttatgccaacgggctgggggcacagctgcctggcttgcagccgtcggacacgtcgggctcctcctcttcgtccagctcctcctccagctcttcatcctcttcctccgggcttcggcgtaaaggcagccgcgactgctccgtgtgcttcgagagcgaagtgattgccgcgctggtgccctgtggccacaacctcttctgcatggagtgcgccaatcgcatctgtgagaagagcgagcccgagtgcccggtctgccacaccgcggtcactcaggccatccgcatcttttcttaaaggcagcgggcgctgctagtgcgcaccgtgctgggggaagggggaacccctccccatcctctttccccagcgctcgcctgcctccctgggtgccccccctctcccttctccttcccggccccaccaacactctgagatccgagaggagcttggaaagctgtagtatccgctcatttttaaaatttaatttttaagtaaaggaatttgccaggatatctgcatcaagagtactgtagcctgggaaacctgaacacctgaaatgcatgctctataaataataggaacggcgacattctagtaatgatagtttttacactgtacttaataggaagcttccaaaagaagaaaaccccacaagttttccattttcttaaagtaggaaaaaatgaacagtaataattatgatgaagatgatagtagtgctatgggatgtgtggactgtttagtgtgttcccctttgtgggtgggttcctatgatacttattatagaacacagtggatcctttttgaatgttcgtggaagggccaggagttcctgtgaaaccaggatactgcagctttattaaagttaaagaaactgtaacatatctcttatatattaaaaacgtttaaaagttttagagagaaattgcattaatacagattgaagtattttattcttttttgacttgaaaaattatatttcatattgcaaagatgtttacaagtattttaatttaagttcagtgaacttttttgtagctgggttaaatctttttattttagtatggccttatggcaaagaacactgtattattttaataatcacacaattgtgacggaattacaaccataaaatgtgtaatgttttgaacagtattctgttgggatggagattttataggttcagacaaatcttctagatctgcttcacccagcatattttctattcagtgatataaagcatattttattctatattattacaaaaacggaaatgtataaacatgtcaaaaagaactgttgatgctttctaacatttgtataaatagaattcagtgcaagttacaaaaattctgttgcaccactctagttttagtatttctattttaatacatttgtttaccacttgtttatgtatatgtaggtgatgttacttgagcttaaatgtactttactgagcaaagtttaaaaaacaaagtatattttattttatgataaagggcctttaacctcatggtcaaatactaatattatatttgctgagacaagatttgaaattgtatcaagagttttatttttctgacatttaaagttctacataataaaggtaaaacttaagtaatggtgctacttcattttttaagtatttctatataaataaaatattgaag

SEQ ID NO: 28243 - DNA, 1769 bp, Homo sapiens
tgagatctcttctctcaatggcattggagctggctgtgcctgaggcagacctggaccgtggacatggggcaatgccttgagcggaaggggaagccactgaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgatactggcgtgcagattcttctctctctatctctctctctgtgtggggggagggtggggagggtgtaaaacaaactgaatttcatcctagctcagctataaagccaagaaacagaatccacctaactaggcagaattaaggaaacaaggactaaagccaatatggacaatgaaaagctaattgtactgccaatgatactattcagaaaaatagtgaatgagtgtgacatatattattatcactactctcttcaaagggtatgtgctcacacttgtgtgaattgatgtatgcacataacaaagagtctgcctgtccttcaggaaatgccagaggaaaaagattctttggctgagctgatgctctcagtgtcaatagctccagccctatgcaatctccattcttccacccccatctctatttcacaggttgctgtaaagagaagaaaattcttattgtaatctttattcaagccaagtcttgataccctggggctgtgggagaggaatggcaagccatggaagaatagaggagccagaaagatgggaatagaaagtctgtgctaagtaccaggcaggactggtcttcaaccttgatgtcttatgatactgtagttaattttgttcactaccagctatttatttgcaaacgttcgtggttcaacattctgcttaaagtatggacagttatcttcttcatcgatgtgtggccatatgtttctattcctctccttaaatcctccctccatcctgagaccactctttcttaatgttctaattttaactaaatgcatgtaaatgtatgtaaaaa

SEQ ID NO: 28244 - DNA, 1328 bp, Homo sapiens
gtaccaatcacaagtcttgttattttgtttcattatgagaaagataatctactaaatattaaaatactggaaggagcaagatagctttgatccagggagaccttttccatttatgtgctttagtaatctgccgccaacaagctatcttctttatgttcttctacaactgatgttgttttgttttctcatgtttgtctcttaatagacaaatggaggcatgagcttccttagaattaccccttcgacgcatagttctgtttcatctggacttttgaggcttagtatctttctactacttagctttcctgactcaaacggaaaagccatttggacagctcacctgaatataacatttcaggttggaaatgagatcacatcggaattaggagagagtggagtgttcgggaatcattctcctctggaaagggtgtctggtgtggtggcacttcctgaaggatggaatcagaatgcctgtcatcctttgaccaatttcagcaggcccaaacaggcagactcatggctggccctcatcgaacgtggaggctgtacttttacacataaaatcaacgtggcagcagagaagggagcaaatggggtgatcatctacaactatcaaggtacgggcagtaaagtatttcccatgtctcaccaggggacggaaaatatagtcgcggtgatgataagcaacctgaaaggcatggaaattttgcactcgattcagaaaggagtctatgtgacagtcatcattgaagtggggagaatgcacatgcagtgggtgagccattacatcatgtatctatttaccttcctggctgccacaattgcctacttttacttagattgcgtctggagacttacacctagagtgcccaattctttcaccaggaggcgaagtcaaataaagacagatgtgaagaaagctattgaccagcttcaactgcgagttctcaaagaaggggatgaggaattagacctaaatgaagacaactgtgttgtttgctttgacacatacaaaccccaagatgtagtacgcattttaacttgcaaacattttttccataaggcatgcattgacccctggcttttagcccataggacatgtcccatgtgcaagtgtgacatcctgaaaacttaagaaatctggagaattttctgaagatgtaaccagatctttccaaatacaaagattagataaattgtcttattgtactttatgtagagagaaaatttcagcttctctacccaagtatgaacaagggtgaaatttgtgttttaaaaataaaactccttatcatgcccagcaaaaaaaaaaaaaaaaaaaaaaaaaa

SEQ ID NO: 28245 - DNA, 1723 bp, Homo sapiens
agcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagggactgggtcttcacttcttgggctaataaaattgtttctttgtggactaaaaaaaaaaaaaaaaa

SEQ ID NO: 28246 - DNA, 2375 bp, Homo sapiens
ggacgggggcgcggagctgtgggaaactgcgccaggcgcccgaaaggtgaacacgggagtcgcgcgtctcccccgcagcagcggtaaagcggaagttatgctgcagccggagcccgggcttcctcccggagccgcgtcccggggcccggctgccccgagctgagcggagcatcctttccgggtgaggggaggagaggacttggcgcgttcccctcgctgccccgggagccgcagccgcggtgttcatgccgcggagcagccaggctcctccgacgaaaacctgcatttatttgctggcgggacgtttgccttgaaaatggacaaagacgccgccctccggggtattcctgtttgcctgaccctgagagcgcctttttgcttcaagacgtgttggatgctcctgttctccgaattctgatacgcttctgggcataatactgaaacacaaaactgcttttgctctctctgtggttggccgaaaataggattctttttcgtgcaggtgtcgttgtttagtcggctttactaacatattgaaatggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtggctgatgactatcagccagttcgtctgctcagtaaacctggggaactgagaagagaatatgaagaggaaataagcaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattaacaatttctgtgagggaagtatctcggcttctcccttgaattccagaaaatctgatccagttacacccaagtctgaaaagaaaagtaagaacaaacaaagaaacactggagatattcagaagtatttgacaccgaaatctcagtttgggtcagcctcacactctgaagctgtacaagaagtcaggaaagactccgtatctaaggacattgacagtagtgataggaaaagcccaacagggcaagacacagaaatagaagatatgccgacactttctccacagatatcccttggagttggagaacaaggtgcagattcttcaatagagtcccctatgccatggttatgtgcctgtggtgccgaatggtaccatgaaggaaacgtcaaaacaagaccaagcaatcatgggaaagagttatgtgtcttaagtcacgagcgacctaaaaccagagttccctactcgaaagaaactgcagttatgccttgtggcagaacagaaagtgggtgcgcccccacatcaggggtgacacagacaaatggaaacaacacaggtgagacagaaaatgaagagtcgtgcctactgatcagtaaggagatttccaaaagaaaaaaccaagaatcttcctttgaagcagtcaaggatccatgcttttctgcaaaaagaagaaaagtgtcccccgaatcttccccagatcaagaggaaacagaaataaactttacccaaaaactgatagatttggagcatctactgtttgagagacataaacaagaagaacaggacaggttattggcattacaacttcagaaggaggtggataaagagcaaatggtgccaaaccggcaaaaaggatccccagatgagtatcacttacgcgctacatcctcccctccagacaaagtgctaaatggacagaggaagaatcccaaagatgggaacttcaaaaggcaaactcacacaaagcatccaacaccagagagaggctcaagggacaaaaataggcaagtgtctttaaagatgcagttgaagcagtcagttaatagaagaaagatgccaaattctactagagatcactgtaaggtatccaaaagtgctcactccctacagcctagcatttcacagaaaagtgtttttcagatgtttcagagatgcacaaagtaaggcctggtaaagggagtgctttgtgatctagtaaagctggaatgtgaagctctttcctatcaaaaaaaaaaaaaaaaaaaaaaaaaaaaaaaaaaaaaaaaaaaaaaaaaaaaaaaaaaaa

SEQ ID NO: 28247 - DNA, 1851 bp, Homo sapiens
gcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcatagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctc

SEQ ID NO: 28248 - DNA, 1757 bp, Homo sapiens
gagcgcggaggcgggcgttgctacggcaacggtgggcggccagggagttgcctgagggaaaaggggcagacgtccctgggttccggtgttcgcggaggagtcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaaaaaaaaaaaaa

SEQ ID NO: 28249 - DNA, 4581 bp, Homo sapiens
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 28250 - DNA, 4748 bp, Homo sapiens
gcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 28251 - DNA, 4431 bp, Homo sapiens
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 28252 - DNA, 4479 bp, Homo sapiens
cttccccctcggggtggaaacaaagggggttcggcgcgcggtgcggagcctgggggaaaagggaggagcgctccggtggtctggcgcgctgggctcgctagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 28253 - DNA, 4275 bp, Homo sapiens
cttccccctcggggtggaaacaaagggggttcggcgcgcggtgcggagcctgggggaaaagggaggagcgctccggtggtctggcgcgctgggctcgctagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 28254 - DNA, 4598 bp, Homo sapiens
gcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 28255 - DNA, 7230 bp, Homo sapiens
cgcccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggtgttgttacagatcttataacagtcggtttaaagcggggatctgatgagcttctttcttctggcatcattaacggaccttttaccatgaatagttctactccttctacagctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaa

SEQ ID NO: 28256 - DNA, 1112 bp, Homo sapiens
tagcacttcatagactgctatcacgcattcatttttactagtacctattgaacactaagttccaggcactgggctaggcactgggatggtgtggtgagcaaaaactgaccagtcctgccgtggagtttgctgggggagacacatgttactcaaagaatcacactaaggatagcaatttatctcaaagctgcaagttcctgccatctacatgtgcccagagtccccaaaattgagtgtcaaacagaggctgggtgacctcctgtccaggattgctctcatcgtatgaatcgaagttttcatcttaacgtgtttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatccattttcttgtacaactggtacacactaataaacaattaaaaaaaaaaa

SEQ ID NO: 28257 - DNA, 1052 bp, Homo sapiens
gcgcgtccgtagtggcggctggcgctagggaactgcagggtctagggtgttgttggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacaaaaaaaaaaaaaaaa

SEQ ID NO: 28258 - DNA, 1281 bp, Homo sapiens
aatcatttgaaccaagttgcggacatgaatcttgttatttgtgtcctacttttgtccatttggaaaaataattgcatgactacaaaccaaaccaatggatcttctactacaggagataaacctgttgaatcaatgcagacaaaattgaactaccttagaagaaatctactcattttagttggtattatcatcatggtttttgtctttatctgtttttgttatctccattataattgtctgagcgatgatgcgtccaaagcaggaatggtcaagaaaaaaggcatagcagccaagtcatctaaaacatcattcagtgaagccaagacagcctctcaatgcagtccagaaacacaacccatgctatctactgcagacaagtcatctgattcatcgagtccagaaagggcatccgcacaatccagcacagaaaaattaatcagaccctcaagtctacaaaagccatccataccaaacagtgcaggaaagttaactaggccatcatatccaaaaaggtcatccaagtcatcatgctcaaaaaaattaagcaagtcatctcacctggaaaaggcacataagaaaggcagcctagaaaaattatgtaagctagactatgcgtgtaagctagccagttcagataagccagtcaggccacctcagctattcaagccactttattcatctcatccacaaaatgaaatctcaccatccaagccattcggtccacaggaattggctaagcctcccaaacattttaatccaaaaaggtcagtgagtctaggcagggcagccttattatccaactctgaattagctgaaacttgtcaaccctacaagaaaaaacatcttgttgccaaaacttataggcctttggtcaatgatatttctgaggcaaaggagaaaaacactcaaaacctacatgtttcaagcaaagtcaagtcctcttccaggtcctttcgtaagttagattccaggaacaatgcatacggtgatcatgtgaatgacagtgatacgatgaaatattatagtgaggttgacagtgataaagttataatcattacgtgtgacagagggtacaatcaagtcacctctgaagtaaccctaaatgattaggagctcaacaaaaataaaatccaagtgtgaaagagcaaacttataccaactattttatgctcatcatcccttaagaaaccagtagagggaaaaatcactatcaagatcacccatatctgtcttggaggcgatttattttaaaaatatcaataaaatgcatgacataaatta

SEQ ID NO: 28259 - DNA, 732 bp, Homo sapiens
ggcagcaacagagttgcaggtgtaaaataacgggaaggcgggatgcgtggctaaattgctctgcgtgcacaaagagtaggagagcccagagttccagaatgcccctaattccgaacaccacagggtgagtctggagcaagtcacctgggagggcttacaggtgccataatgaaggcctggggcactgtggtagtgaccttggccacgctgatggttgtcactgtggatgccaagatctatgaactctgcgagctggcggcaagactggagagagcagggctgaacggctacaagggctacggcgttggagactggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatgacctgctcaatcgccatattctggatgacatcaggtgtgccaagcagattgtgtcctcacagaatgggctttctgcctggacttcttggaggctacactgttctggccatgatttatctgaatggctcaaggggtgtgatatgcatgtgaaaattgatccaaaaattcatccatgactcagattcgaagagacagattttatcttcctttcatttctttctcttgtgcatttaataaaggatggtatctataaacaatgc

SEQ ID NO: 28260 - DNA, 1032 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaaaaaaaaaaaaaaaaaaaaaaaa

SEQ ID NO: 28261 - DNA, 1008 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttccca

SEQ ID NO: 28262 - DNA, 1008 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttccca

SEQ ID NO: 28263 - DNA, 488 bp, Homo sapiens
gcccatggccgcagccctggcgctcgtggcgggggtcctgtcgggggcggtgctgcccctctggagcgcgcttccgcaatataaaaagaaaatcacagacaggtgcttccaccactctgagtgctacagtggctgctgcctcatggacttggactccggtggagccttctgtgcccccagggccagaataaccatgatctgcttgccccagtggttggaactcttcaagggcagggattgcatcatattcatctatgaagcacctacccccagcttagtatctgcacataaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtc

SEQ ID NO: 28264 - DNA, 5730 bp, Homo sapiens
cctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaacaaaaaaaaaaaaaaaaaaaaaaaaaaaaaaaa

SEQ ID NO: 28265 - DNA, 694 bp, Homo sapiens
gacatcaccaagggcctggcaccaggtgcccagtcttccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgccgtgtggagagcactttcggattcggcagaacctaccagagcacacccaaggctggcttgggagcaaatggctctggcttttgtttgctgttgtgccgtttgtgatactgcagtgtcaaagagacagtgagaagaataaggagcagagtcctcctggccttcgaggcttcccatttcgcactccactaaagaaaaatcaaaatgcttctctttacaaagactgtgtattcaataccttaaacgaacttgaagtggagcttttgaaatttgtgtccgaagtgcagaatcttaaaggtgccatggcaacaggcagtggcagtaacctcaagcttcgaaggtcagagatgcctgcagatccataccatgtcacaatctgtaaaatatggggagaagaaagctctagctgaatggatttgtgtgtcaggagagaaaaaagttgagtgttgacaaactgtatgcaaactaataaaactattctgaagaaaagaa

SEQ ID NO: 28266 - DNA, 3861 bp, Homo sapiens
atgtcacatctggtggaccctacatcaggagacttgccagttagagacatagatgctatacctctggtgctaccagcctcaaaaggtaagaatatgaaaactcaaccacccttgagcaggatgaaccgggaggaattggaggacagtttctttcgacttcgcgaagatcacatgttggtgaaggagctttcttggaagcaacaggatgagatcaaaaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggacacagacagctccacacagccggtgcaccggtgccggagaaacccaagagggggccaagggacaggctgagctacacagcccctccatcgtttaaggagcatgcgacaaatgaaaacagaggtgaagtagccagtaaacccagtgaacttgtttctggttctaacagcataatttctttcagcagtgtcataagtatggctaaacccattggtctatgcatgcctaacagtgcccacatcatggccagcaataccatgcaagtggaagagccacccaagtctcctgagaaaatgtggcctaaagatgaaaattttgaacagagaagctcattggagtgtgctcagaaggctgcagagcttcgagcttccattaaagagaaggtagagctgattcgacttaagaagctcttacatgaaagaaatgcttcattggttatgacaaaagcacaattaacagaagttcaagaggcatacgaaaccttgctccagaagaatcagggaatcctgagtgcagcccatgaggccctcctcaagcaagtgaatgagctcagggcagagctgaaggaagaaagcaagaaggctgtgagcttgaagagccaactggaagatgtgtctatcttgcagatgactctgaaggagtttcaggagagagttgaagatttggaaaaagaacgaaaattgctgaatgacaattatgacaaactcttagaaagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctgaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccacagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatga

SEQ ID NO: 28267 - DNA, 2963 bp, Homo sapiens
ggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaatggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaattcggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaaaaaaaaaaaaaaaa

SEQ ID NO: 28268 - DNA, 735 bp, Homo sapiens
cggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttccaaaaaaaaaaaaaaaaaaaaaaaaaaaaaaa

SEQ ID NO: 28269 - DNA, 7723 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaaggaaaaaaaaaaaaaagaatgtactcatacagatttttgttagtcatcatgtaataagccatttatatcagaaaccttttttcctgccacagaagctttaaattttcccctaagagtacaaagccaagagagtgtggtttatctaaatgtcctgaaatccacttgtcattccttaatttctcctctatgcaattaaagagaaaggggaaatctataacatttcttttgcccaagtgacacaaaaatgattactgcatagaaatcaaatgtaagtttagcttctaaatgaaataatatataggagggatatcagaatgtctagatagagaaagtattttcaaattcttgaatatatggatgctattaaaagctgctttccattgcctggaaagagagcttttttccctcctctattcagtgtttcaaactttggtcatctcaaattattgtcacttttaaaatgttaatgtcattctgagcagaaatagatatattttcagatttttttacactgatgctactccgtaattgcttaggagtattgtccatcatagtattttagaactagaagtaaacacataaatccttataaattacccaatccaactttctcatattgcatgtagagaacctgagacacatatcaaagtctagaatccttaacttctccccattttgtttttttccgcctcatcacaccatgctgcctttccctcatatgatcaccaaccagtagctgagttcaaaaactacatatttcttgggcagtcctctactggtatgtgatgccaacttttatttctttcgaagataattgccttctttgcctagccaagcagccaattttattggagaaaagcaagttatatgttcacaaaatggaaggctttctacctaaatttatttcatctgtggtcctcttattctcttccattgcttttgacatacagtggaaaaacttggccaacgatgtgctctaaatatagtgcttgtgttgggttaacttttccattaatttctcaacatcaattattcaggcccctacagttgtggtattgaggcccctaaaggcttctgcctttcaccaattagtgctgccagttactgaggcttctcccaaaaggtatcagtccagtcttaaagatatttcattgtgaaagaagaaactaaactatcaggcctcttttacaaaatgagagattgaatttaagcttgtcaagcacgtactggaaggtatgaattacactaccatgtgttttgtatcttccctttcaagtgatgatgttaaatgaaggtaagtttttcatccttttttaatttttgttttttataaatcatttcagctttttctggtttatagaggtgtcttatttctaatgcaacagacccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaatattgcttgtattcctgtcatagaacaggttttgtaatctttaaaagaaatgaaaatttatataataaagtttcaaatcaatgcaaaaaaaaaaaaaa

SEQ ID NO: 28270 - DNA, 7370 bp, Homo sapiens
atgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacactagcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagg

SEQ ID NO: 28271 - DNA, 7535 bp, Homo sapiens
atgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactggtcagaaacccttcccttgtcaaaaatgcgatgccttcttttctaccaaatctaactgtgaacgccaccagttgcgcaaacacggagttaccacctgttccctgagaagaaacgggcttatcccccagtcaaaagagagtgatgttggatcccatgatagcacagacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacactagcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagg

SEQ ID NO: 28272 - DNA, 7555 bp, Homo sapiens
ttcagacacctgagagcatcctgttctgggtacagtgtgtgtatgtatatgtttgtttgaagccgctggtcctcgccttttactccttagctggacagcgggttcgggatctgccccatgactaaggctgaagtggaaagttgcgaagatagaacaagagttgttccttagggtggtgtccctaaacttgaaagtggacttggtcctgctcgcaggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacactagcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagg

SEQ ID NO: 28273 - DNA, 3984 bp, Homo sapiens
ggaaaaccgaggaatacacatgcgcagttggacccctcaggcccttcgtgtcccttcccacccatctccccgccccggccctctgggcggggctgggccgacagtccagctgcagctcgctggagattcagtgacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggcagaggttgcagtgagccaagatcgcgccactgcactccagcctgggcgacagagtgagactccatctcagaaaaaaaaaaaaaaaaaaacagaatctcagtgtattctcaaagtaaaaaggcataaccaagcactctcttatcttgccttattgctatactatttacatcccactgcagaacagcagatttgaggcttttctatatacttctcagagcactgaaaagaaaggaagggtttgcagaggagagtgtagaaatcccagtggtagcatgtaccaacaggtgagtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttaggtattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgcaaaaaaaaaaaaaaaa

SEQ ID NO: 28274 - DNA, 1719 bp, Homo sapiens
gtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgattcaagtcgtggatgaaatagatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttcaaaaaaaaaaaaaaaaaaa

SEQ ID NO: 28275 - DNA, 819 bp, Homo sapiens
gtgatgctccctgggcctcctgaccgcgccctcgcctgggaggcggggcgggccgggttctctctgtgacgtcacaaaggccccgccatgcctctggctttgacccttctgctgctctcgggcttgggcgcccccggaggctggggctgcctgcagtgcgaccccttggtgctggaggccctgggtcacctgcgctccgccctcatccccagtcgcttccagttggagcagctgcaggcgcgcgccggggccgtgctgatgggcatggaggggcctttcttccgggactacgcgctgaacgtgtttgtggggaaagtggagacaaatcaactggaccttgtggcgtcctttgtcaagaaccaaacgcagcacttaatgggtaactctctgaaagatgagcctctgctggaagagctggtgaccctcagggcgaatgtgatcaaggaattcaagaaagttttaatttcatatgaattaaaagcctgcaaccccaaactttgccgcttgctaaaagaagaggtgttggactgtttacattgccagaggatcactcccaagtgtatccacaaaaagtactgctttgtcgaccggcaaccccgcgtggccctgcagtaccagatggacagcaaatacccgaggaaccaggcgctgttgggcatcctcatttctgtgtctctggctgtctttgtcttcgtggtcatcgtggtctcggcttgtacatacagacaaaaccgaaaactcctgctgcagtaggacggtggtttgggggtaaggagaaaggaaaataaatttaataaaattggtgacaaatccaaaaaa

SEQ ID NO: 28276 - DNA, 2592 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaacc

SEQ ID NO: 28277 - DNA, 1744 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggcacccaactcagtgatgtcctaattactgctggatgactcaagccacaccatgcctatgttctcaggtgaagaagaataatagaaaccacatagatgggtaggtgtaccaagcattaaacagacagtatccaaaaaaaaaaaaaaaaaa

SEQ ID NO: 28278 - DNA, 4214 bp, Homo sapiens
ctgagctgggtgggggtgccccacgctgaaagagagtgatggagtgcccagtgatggaaactgactcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttgaataagaagcttatagacatagaagctctcatgaacaataacttgataactgcaattgaaatgagcagtctttctgagttccatcagagttcctttctactgtcagctagcaagaagaaacgaattagtaaacagtgcaagttgatgcgtcttccatttgcaagggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccagaatatattggagttgaaaaagtatgttactgataggaaatctgctgagcaaaatgaatcaaaaataaataagctcaggaataaagtgaattggaagacagaaataatttctgaaatgaaccagatatatgaggataatgataaagatgcacatgtccaagaaagctatacaaaagatcttgattttaaagtaaataaatctaaacaaaaacttgaatgccaagacattatcaataaacactatatggaagtcaacagtaatgaaaaggaaagttgtgatcaaattttagattcctacaaagtagttaaaaaacgtaagaaagaatcatcatgcaaggcaaagaacattttgacaaaagctaagaacaaacttgcttcacagttaacagaatcttcacagacatctatctccttagaatctgatttaaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtaaaaatgtgataataaaagaaaattttgccttggagtgctccccagcctttcaagtaagtgatgatgagcatgagaagatgaacaagatgaaatttaaagtcaaccggagaacccaaaaatcaggaataggtgatagaccattacaggacttgtcaaataccagttttgtttcaaataacactgctgaatctgaaaataagtcagaagatctatcttcagaacggacaagcagaagaagaaggtgtactcctttctattttaaagagccaagcctcagagacaagatgagaagatgaagtgaatttatggattctggtttttctgaattttcaaagcataaggaatcaaaacagaaatatagtatcaagaagatgaaatgcttaatgaaaaggttttttttttgtttctttggcctttcatggagtgttgatttgtccattcttaatgtttattaataggtatatgtgcataaaatagctattttgtaacattaaaccttttgagtcattttggtcatcatataacttaccttcctgtttatttaagcttctttttacctagtagcctttaaccaaacaataaccttttaaccaaataaaatgtgttaataaataaaaaaaaaaaaaaaaaaaaaaaaaaaaaaaaaaaaaaaaaaaaaaaaaaaaaaaaaaaaa

SEQ ID NO: 28279 - DNA, 4490 bp, Homo sapiens
atggcctcttggcgcaaacccgcctcccctggaactccaggggccctcaggccctctgcgctgtgcccacctgtcagggtgccccgctcccggtctgcagcctttgcgcccccactggccctgagcccctgtgtcctggtttctctgtggtgtggtgcatgggcaggttccgggggggtttcctgcagatgtcaggttggatacacagcagccttggctcatcgcccggtctcctgggacgatagcgctccccgtcccagtgccgtggctggagctgctagcccgattccccacctaaagggcccgaaggatggggccacggcccatgaagaaagtgaggaggaggatgcgcaacgaccctccactcacaagggccgggcccgaaccaccctgagcgcctcctccgagccaggctcgatccttcacactgggaacggagacactccggtccagtgtcacttgtcctcgagtaagaggagagggatgacaggcgagcaacggagtcacaagggctctgcagagaatgaagcgcggagcgccgggcgtgggcagtgccagggcccctcgcggccgctgattgggtggtgcggccgagcggagcggctccgcgggcgccgattgcctcctccgtcccctgcagcggagcccagcacgctcctgggtccggggactctgccggggcccctggccgttccccgcagcgccccgagcgaggtagcgcagcgggaccggcagcccactctggagcgcttcgcacccccgcgcccgcccctcaggggcctcggcccacccgcccctggaacagcgcttcccgctcccgtgtcgcctgtttcgagaggccgtgaagcagcacccccagcacacgcacgcacctcgccttctcctcaccccgctgttctcttctcatcactttaccccccatgccgcctccaccaccccagctgggtgcccccagagggcgggcaccttcgtccaccggcggcggggcctgacacacagtcagcctcggaaacattccaagaaggaccagagctacgagcaccccaggaggtagtgctgggggatccccaccctacagctgaggacctggaggctgagagcttaagtgacttgcccaagcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtccagatcctgcacctgctgctgtgccgctctttccagctggcttacctcttgcagcaccctgaggagcgggcacagccagagccctgcccagggcccacaggggaggtgcccctgaagccactgtccagctctgggggcctggtgcgggagcccttcggccgtgatcagctctctcagaacgtccatgccctggtctcctttcggcggctgccagcagaggggctggtgggcagtgggaaggagctgccagagtcggaaggccgtgcccgccatgcccgcctggggaatccctactgctcgcccacgctggtgcgcaagaaggccattcgcagcaaggtgatccgctcgggggcctaccgcggctgcacctatgagacccagctgcagctgtcggctcgggaggcctttcctgccgcatgggaggcatggccccggggtcctggtggccactcgtgcctggtggagagcgagggcagcctgacggagaacatctgggccttcgctggcatctccaggccctgtgccctggccctgttgcggagagacgtgctgggggccttcctgctgtggcctgagctgggtgctagcggccagtggtgtctgtccgtgcgcacgcagtgcggcgtggtgccccaccaggtcttccggaaccacctgggccgctactgcttggagcacctgccggcagagttccccagcctggaggctctggtggagaaccacgcggttactgaacgtagcctcttctgtcccctcgacatgggccgcctgaaccccacctacgaggagcaggactgtgggcccccaggcaggccgccccggactctccggcccctcagccatgccaagtccgaggcagagctgcagggcctgggctaagaggtagggccccggtcccacaggccccgcctcaccccggctcctgggccccagcagcatctctgcccgtcctgcacccctctggttgccagttccatccagtcaccctgcccttggagcagtcttccatcgcgtcactgtccgtgggaggggagccctgagggtgggtatcgccaatggcttcttggagaacatgtggcctgctgagattccaggagggcaggtggagttgcaggcttcggataaccctttgggtggcttcggatgacctgctgtgtggcttcggatgctttgggacttctgggcttctgctttactcctggggcaggagcttgttcacggcaaagctgcagccctctcctaaggaggctaggccttggggcgctgactgggagtctccagaaagagggttttggggaggcaggagtgagcttttactctgggcaaagacctggagtgagccaccctgtctatgagagcagagatgactccatggagcttgtgggcaggaggctggggatgagccccatctaggctgacagagcagggctgtttctcatatgtatctgagagtgaaggaggggtgggaaggtgcagagagggcaggagggacagagggctgtacctaacgctcacgcacggtggactcctgtgtgcagaaagggatgcgcaccagcagacagggccaagaatctccatgctgtctccactcaaaacctcagggctgtgactcccgctttctcagaagggatgcgcaggctcaccccttccccctaggaatcaccagggcacccccacccccagctcatctcctttagccatttgacagggaggggccagcagtgagctgcaggcttagaggggtgaccagggcccttcctaactcgaccgcatgtggtttggtggctgccttgggagggaggctgtccgatgctgacattccccttagcatggccctgaccgtggctgtcaggggccaccttgcctcaccaggccagccccactgggaatggggtcagtcacagcagaaccgtcgaaaggtggacctgatgtgggccctgccgggggcgcttggcctcagcgggccatgggagacccagggaaacgactctagtgtgaggcagtggtcctgccagtgactgacaaaccctctttgtaagcaaacttgacaaataatgaatctactgaactctgttatagaacaagttcattttgcatgaacttctcttattgaagcagaagccacgtcatgagcctgggggctgccctctccccgtctgggagtgggacagaactgttcagtgccttgaaagtcacagatttctgactcctggaaggaactgggcagtcccaccagagcagaaagaaaggaggcaaacttggggagtgagaagccagcctcccagaggcccaggcctcgtgttccccacctccaaccctcccgtgaggagaggggcttggcctgggaccttgtaacttccttgcaagttaagtgagctatcctgtcacaaaagatagaaggaactgccctttgggacttcttttcactggaaacccagcactggttttatgttgagtgagtgggaagctgggactctgttttacagccatctgtactggagcctggacaaaccactggtctctatgggaggccccagcctcacatttccctggcaaggagagagaggtttagccatgtcctgggtctaggattacagcccagagatgggcacttaagaagacctggtcattggtccagacttgggccaaggctctcctctgtgagggatgggttttactggtgaattacctgtgtggagaagctatcagggccatgtttagcacactgaagggaccagtctccaccaagcactttaacatccctccagccagcatagattgatctcgtgttacagagagggcaaggtttttggcccctgtttgcagactccatgtcttaatcagagaccacagttttctctttgttccaatctgcgccacctcggtagccccactttccttgctgtgtggacttgaaacaaaataaaatgtgttgc

SEQ ID NO: 28280 - DNA, 4388 bp, Homo sapiens
atggagcccacaagagttggtaagaggaaacgagatttcccggaaataaagcagcaggagtgcttcagatgtcaggttggatacacagcagccttggctcatcgcccggtctcctgggacgatagcgctccccgtcccagtgccgtggctggagctgctagcccgattccccacctaaagggcccgaaggatggggccacggcccatgaagaaagtgaggaggaggatgcgcaacgaccctccactcacaagggccgggcccgaaccaccctgagcgcctcctccgagccaggctcgatccttcacactgggaacggagacactccggtccagtgtcacttgtcctcgagtaagaggagagggatgacaggcgagcaacggagtcacaagggctctgcagagaatgaagcgcggagcgccgggcgtgggcagtgccagggcccctcgcggccgctgattgggtggtgcggccgagcggagcggctccgcgggcgccgattgcctcctccgtcccctgcagcggagcccagcacgctcctgggtccggggactctgccggggcccctggccgttccccgcagcgccccgagcgaggtagcgcagcgggaccggcagcccactctggagcgcttcgcacccccgcgcccgcccctcaggggcctcggcccacccgcccctggaacagcgcttcccgctcccgtgtcgcctgtttcgagaggccgtgaagcagcacccccagcacacgcacgcacctcgccttctcctcaccccgctgttctcttctcatcactttaccccccatgccgcctccaccaccccagctgggtgcccccagagggcgggcaccttcgtccaccggcggcggggcctgacacacagtcagcctcggaaacattccaagaaggaccagagctacgagcaccccaggaggtagtgctgggggatccccaccctacagctgaggacctggaggctgagagcttaagtgacttgcccaaggtcacgccagccaaccatcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtccagatcctgcacctgctgctgtgccgctctttccagctggcttacctcttgcagcaccctgaggagcgggcacagccagagccctgcccagggcccacaggggaggtgcccctgaagccactgtccagctctgggggcctggtgcgggagcccttcggccgtgatcaactctctcagaacgtccatgccctggtctcctttcggcggctgccagcagaggggctggtgggcagtgggaaggagctgccagagtcggaaggccgtgcccgccatgcccgcctggggaatccctactgctcgcccacgctggtgcgcaagaaggccattcgcagcaaggtgatccgctcgggggcctaccgcggctgcacctatgagacccagctgcagctgtcggctcgggaggcctttcctgccgcatgggaggcatggccccggggtcctggtggccactcgtgcctggtggagagcgagggcagcctgacggagaacatctgggccttcgctggcatctccaggccctgtgccctggccctgttgcggagagacgtgctgggggccttcctgctgtggcctgagctgggtgctagcggccagtggtgtctgtccgtgcgcacgcagtgcggcgtggtgccccaccaggtcttccggaaccacctgggccgctactgcttggagcacctgccggcagagttccccagcctggaggctctggtggagaaccacgcggttactgaacgtagcctcttctgtcccctcgacatgggccgcctgaaccccacctacgaggagcaggactgtgggcccccaggcaggccgccccggactctccggcccctcagccatgccaagtccgaggcagagctgcagggcctgggctaagaggtagggccccggtcccacaggccccgcctcaccccggctcctgggccccagcagcatctctgcccgtcctgcacccctctggttgccagttccatccagtcaccctgcccttggagcagtcttccatcgcgtcactgtccgtgggaggggagccctgagggtgggtatcgccaatggcttcttggagaacatgtggcctgctgagattccaggagggcaggtggagttgcaggcttcggataaccctttgggtggcttcggatgacctgctgtgtggcttcggatgctttgggacttctgggcttctgctttactcctggggcaggagcttgttcacggcaaagctgcagccctctcctaaggaggctaggccttggggcgctgactgggagtctccagaaagagggttttggggaggcaggagtgagcttttactctgggcaaagacctggagtgagccaccctgtctatgagagcagagatgactccatggagcttgtgggcaggaggctggggatgagccccatctaggctgacagagcagggctgtttctcacatgtatctgagagtgaaggaggggtgggaaggtgcagagagggcaggagggacagagggctgtacctaacgctcacgcacggtggactcctgtgtgcagaaagggatgcgcaccagcagacagggccaagaatctccatgctgtctccactcaaaacctcagggctgtgactcccgctttctcagaagggatgcgcaggctcaccccttccccctaggaatcaccagggcacccccacccccagctcatctcctttagccatttgacagggaggggccagcagtgagctgcaggcttagaggggtgaccagggcccttcctaactcgaccgcatgtggtttggtggctgccttgggagggaggctgtccgatgctgacattccccttagcatggccctgaccgtggctgtcaggggccaccttgcctcaccaggccagccccactgggaatggggtcagtcacagcagaaccgtcgaaaggtggacctgatgtgggccctgccgggggcgcttggcctcagcgggccatgggagacccagggaaacgactctagtgtgaggcagtggtcctgccagtgactgacaaaccctctttgtaagcaaacttgacaaataatgaatctactgaactcagttatagaacaagttcattttgcatgaacttctcttattgaagcagaagccacgtcatgagcctgggggctgccctctccccgtctgggagtgggacagaactgttcagtgccttgaaagtcacagatttctgactcctggaaggaactgggcagtcccaccagagcagaaagaaaggaggcaaacttggggagtgagaagccagcctcccagaggcccaggcctcgtgttccccacctccaaccctcccgtgaggagaggggcttggcctgggaccttgtaacttccttgcaagttaagtgagctatcctgtcacaaaagatagaaggaactgccctttgggacttcttttcactggaaacccagcactggttttatgttgagtgagtgggaagctgggactctgttttacagccatctgtactggagcctggacaaaccactggtctctatgggaggccccagcctcacatttccctggcaaggagagagaggtttagccatgtcctgggtctaggattacagcccagagatgggcacttaagaagacctggtcattggtccagacttgggccaaggctctcctctgtgagggatgggttttactggtgaattacctgtgtggagaagctatcagggccatgtttagcacactgaagggaccagtctccaccaagcactttaacatccctccagccagcatagattgatctcgtgttacagagagggcaaggtttttggcccctgtttgcagactccatgtcttaatcagagaccacagttttctctttgttccaatctgcgccacctcggtagccccactttccttgctgtgtggacttgaaacaaaataaaatgtgttgc

SEQ ID NO: 28281 - DNA, 3019 bp, Homo sapiens
aaagcggttggcagcagcggcgcttggaggaaaggaagccggttggagggcgcagcgcacccctgctgcgcggaggagggggctgagctgaactcagcagaagttacatgcacaaggcaaaaattctgacgttctcaagagaccagctctgcccccgtggctcaactgaccctaccatgtggacgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatggggtgcctcgagcaaaggccttatgcaactacagagggcagaatcccggtgacctaaggtttaataagggagatatcatccttctccggagacagcttgatgagaattggtaccagggggaaatcaatggcatcagcgggaacttcccagccagctccgtggaagtcatcaagcagctgccccagccgcccccgctctgcagggccctctacaacttcgacctacgaggcaaggacaagagtgagaaccaggattgcctgaccttcctcaaggacgatatcatcactgtgatcagccgagtggatgagaactgggcagaaggcaagttaggagataaagtaggcatcttccctatcttgtttgtagagccaaacctcaccgcaagacaccttttagagaagaacaaaggtcgccagtcatcctgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggtcagcacttatcaccccgcacctgtctctccaggacattccacagccgtggtcagtctgcctggctcccagcaacacctctcagcgaacatgtttgtagccctgcactcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcccggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttgccaaggccacaaccctggtgtccactgcctcaggcacgcagaccgtgtttcccagcaaatgaacctacgggtggcttttcctagaccccaaagaggtgaattgcatttaaatacagtctgcctccactgagggcatcctgccattctttggggacttgagcatgggtccttgttcttcctatttcacctccaggaaagcaaaagtgggagcagaaattcctgccctgggtgggaggatagatggcgtggccttccaaacatacaaacataatgatttgatgccacaaagctcgcttactcagaccaaggagtgaaaaattgtcgtgcccactttatgccccagcatggagtatgtggcctcttgtcatccccgtgttactgtgtagaatttctatggtgtcctaaagggggctgcagcaggggtgtgacaacggtgggattgttggcgttgcttctttgaccttacaatatcctcaacaagcattagaacaacttctgccatcttctggggcctgtacactggccactagtagctgccatatctttttccctctgtaaagtcataatcctggctgcaaagggaggatttctgcgcggggtgtgaggtggatactttgaacattctgagaacccaataaaactagaaggagccaaaaaaaaaaaaaaaaa

SEQ ID NO: 28282 - DNA, 5129 bp, Homo sapiens
ctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggagcttgaccattggacacttctccagggttcgtggacagacgattactgcatgtccaagttcaagaatacctgctggattccaggatatagtgcaggggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgatgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgacatc

SEQ ID NO: 28283 - DNA, 1668 bp, Homo sapiens
cgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaaaaaaaaaaaaaaaaaaaaaaaa

SEQ ID NO: 28284 - DNA, 6059 bp, Homo sapiens
cgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcagggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggtcctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacgccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtattacttttttagactcccgtctgcacaaaatgcaataaaaataattttattatacccttaaaaaaaaaaaaaaaaa

SEQ ID NO: 28285 - DNA, 1983 bp, Homo sapiens
ggggcggggcgcgctacccgcagcccccggagctcggctaactcggcgcccagtgcacggccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaaaaaaaaaaaaaa

SEQ ID NO: 28286 - DNA, 1417 bp, Homo sapiens
cggagcgtagggttgagcggcttcccccgcactggggtgagagcccagaacaggcggtagagccaccccaccacccccaactccattccccgcgctcgctgcggctggacgtgaaaagccggtctcacgctctggggagttagtcgccttccactgggaccctcagacgagtgagcgaacatgaagtccggtcctggcatccaagccgccatcgacctcacagcgggggccgcaggggggacagcgtgtgtactgactgggcagcccttcgacacaataaaagtgaagatgcagacgttccctgacctgtacaagggcctcaccgactgcttcctgaagacatacgcccaagtgggtctccggggcttctacaagggcaccggcccggcacttatggcctacgtcgccgaaaactcggtcctcttcatgtgctacgggttctgccagcagtttgtcaggaaagtggctggaatggacaagcaggcaaagctgagtgatctccagactgcagccgcggggtccttcgcctctgcatttgctgcactggctctctgccccactgagcttgtgaagtgccggctacagaccatgtatgaaatggagatgtcagggaagatagcaaaaagccataatacaatttggtctgtcgtgaagggtatccttaaaaaggatggccccttgggcttctaccatggactctcgagtactctacttcaagaagtaccgggttatttctttttctttggtggctatgaactgagccgatcgttttttgcgtcagggagatcaaaagatgaactaggccctgtccatttgatgttaagtggtggagttgctggaatttgcctgtggcttgtcgtgttcccagtggattgtattaaatccagaattcaagttctttccatgtatgggaaacaggcaggatttattggtaccctcttaagtgttgtgagaaatgaaggaatagtagccttatattctggactgaaagctactatgattcgagcaatccctgccaatggggcactgtttgtggcctacgaatacagcaggaagatgatgatgaaacagttggaagcatactgaagtgtcttggtgaacctggatccgagtccatgagtttgaggactacagttcatcacagggttcagcagagtacaagaccactgtctaattttgacttcatgggaattttggttttatcttcccttcttctaccctaaatcttaactttatggaagggcctctattttacatcatataatttctgcccataattgtattgaaataggaaagttgctgctcttgcacttgctggaatgtacagggtgggctggttggccctatgtacctaatctgaaaaactaaatatcgttctgtcagggcctttgcataaagccatttgtgtgtacatgca

SEQ ID NO: 28287 - DNA, 1803 bp, Homo sapiens
agcgtcccaagagccactttctcgccagtacgatgctgcagcggttttccggttttccgcttcccttcatcgtagctcccgtactcatttttagccactgctgccggtttttatatccttctccatcatgcatcgtgagcctgcgaaaaagaaggcagaaaagcggctgtttgacgcctcatccttcgggaaggaccttctggccggcggagtcgcggcagctgtgtccaagacagcggtggcgcccatcgagcgggtgaagctgctgctgcaggtgcaggcgtcgtcgaagcagatcagccccgaggcgcggtacaaaggcatggtggactgcctggtgcggattcctcgcgagcagggtttcttcagtttttggcgtggcaatttggcaaatgttattcggtattttccaacacaagctctaaactttgcttttaaggacaaatacaagcagctattcatgtctggagttaataaagaaaaacagttctggaggtggtttttggcaaacctggcttctggtggagctgctggggcaacatccttatgtgtagtatatcctctagattttgcccgaacccgattaggtgtcgatattggaaaaggtcctgaggagcgacaattcaagggtttaggtgactgtattatgaaaatagcaaaatcagatggaattgctggtttataccaagggtttggtgtttcagtacagggcatcattgtgtaccgagcctcttattttggagcttatgacacagttaagggtttattaccaaagccaaagaaaactccatttcttgtctcctttttcattgctcaagttgtgactacatgctctggaatactttcttatccctttgacacagttagaagacgtatgatgatgcagagtggtgaggctaaacggcaatataaaggaaccttagactgctttgtgaagatataccaacatgaaggaatcagttccttttttcgtggcgccttctccaatgttcttcgcggtacagggggtgctttggtgttggtattatatgataaaattaaagaattctttcatattgatattggtggtaggtaatcgggagagtaaattaagaaataacatggatttaacttgttaaacatacaaattacatagctgccatttgcatacattttgatagtgttattgtctgtattttgttaaagtgctagttctgcaataaagcatacattttttcaagaatttaaatactaaaaatcagataaatgtggattttcctcccacttagactcaaacacattttagtgtgatatttcatttattataggtagtatattttaatttgttagtttaaaattctttttatgattaaaaattaatcatataatcctagattaatgctgaaatctaggaaatgaaagtagcgtcttttaaattgctattcatttaatatacctgttttcccatcttttgaagtcatatggtatgacatatttcttaaaagcttatcaatagatgtcatcatatgtgtaggcagaaataagctttgttctatatctcttctaagacagttgttattactgtgtataatatttacagtatcagcctttgattatagatgtgatcatttaaaatttgataatgactttagtgacattataaaactgaaactggaaaataaaatggcttatctgctgatgtttatctttaaaataaataaaatcttgctagtgtgaatatatcttagaacaaaaggtatcctcttgaaaattagtttgtatattttgttgacaataaaggaagcttaactgttaaaaaaaaaa

SEQ ID NO: 28288 - DNA, 2493 bp, Homo sapiens
ccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatggaaaatccttgcttttaagtgttagcaatagttcaaaaaattaagttctgaaaattgaaaaaattaaaatgtaaaaaaattaaagaataaaaatacttctattattcttttatctcagtaagaaataccttaaccaagttatctctcttttatgctactcttttgccactcacttgagaacagaataggatttcaacaataagagaataaaataagaacatgtataacaaaaagctctctccagatcatccctgtgaatgccaaagtaaactttatgtacagtgtaaaaaaaaaaaatctcagttatgtttttattagccaaattctaatgattggctcctggaagtatagaaaactcccattaacataatataagcatcagaaaattgcaaacactagaattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttttgactcccaggccaggatgttttatttctcacatcatgtccaagaaaaagaataaattatgttcagcttaaaaaaaaaaaaaaaaaaaaaaaaaaaaaa

SEQ ID NO: 28289 - DNA, 3024 bp, Homo sapiens
agaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggggtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaaaaaaaaaaaaaaaaaaaaaaaaa

SEQ ID NO: 28290 - DNA, 2945 bp, Homo sapiens
tcggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggtctcctcaggaagatgaaccctcccttgcagaagcgggagctgccccagagagtctgtgtgagatgaagacagaggcccagccttcgacatccttgctggcaaacacctcatggactggcacagtgatttctgacagtgtcccaggaagtcaaacgtgggaagacaagggttcattgacccggtctgcaacatcttggacctcagaggcccaagtttcagcagcccgggttgcagaggctcaggccaggaccagtcagcccaagcaaatttctgtattggaggcgttaactgcctcagccctgaaccagaaacccacgcatgagaaggtgcagatgacagagaagaaagagagtgaggtcctccttgcccgtccgttctggtccagcaaaactgagtatattctggctcaggtgggcttctctatgaagccatcttgtctctggcgctttgcctacctgtggcttaacagtggaggctgcagtttcgctgccatctacatcttcatgctgttcctggtcggggttcctcttctcttcctggagatggcagctggtcagagcatgcgtcagggtggcatgggtgtatggaagatcattgccccctggattggtggtgtggggtattctagcttcatggtgtgcttcatcctcggcctgtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtaatctatgtcttggtactgctcccctgtttcatcattgtcggtttcttcatccggactctactcctggaaggggcaaaatttggccttcaacagttggtggttgccaagatatcggatgtgtacaatatgagtgtgtggtctctagcagggggtcaagttttgtctaacacaggcataggccttggctccgttgcctccttagcctcctacatgccccagtccaacaactgtctcagtgatgcctttctcgtgtctgtgataaacctgctcactttgttggttttcacatctttcaacttctgtgtcctgggcttctgggcgacagtcatcacacatcgctgctgtgagaggaatgctgaaatacttttaaagctgataaacctagggaaactgcctcctgatgccaagccccctgtcaacctgctttacaacccaacctccatctacaatgcctggctcagtggccttccccagcacatcaaaagcatggttctccgcgaggtgactgagtgcaacatagagactcagtttcttaaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcgaccttcaggcagctacttcatcagactgctgagtgactactggatagtcttccccatcatcgtcgttgtcgtatttgaaaccatggctgtatcctgggcctatggggccaggaggttccttgcagacctgacgatcctgttgggccaccccatctctcccatctttggttggctgtggccccatctgtgtccagttgtgctgctaatcatctttgtgaccatgatggttcatctttgtatgaagccgatcacctacatgtcctgggactcaagcacctcaaaagaggtgcttcgaccatacccaccgtgggcactgctcttgatgatcaccctttttgccattgtcatcctccccatccctgcatactttgtatactgccgcatacataggattcccttcaggcccaagagcggagacgggcctatgacagcctccacatccctacccctaagtcaccagctaacacccagtaaagaggttcaaaaggaagaaattctacaagttgatgaaacaaagtacccatcaacttgtaatgtgacttcctaacttcattaatttggcttcacataacatatcccttagaacagatccaatagacaactcttaatatcagcttgcaactgttgatctccctggatccagaaccacttttatttccaagaggaggggcattctttgggggtgttcatggggcctggacttgcaatcccttcctgggtcccatcttacctggtgaccaccatcattgttttccccatcctcttcctcaacacacatacatgcacaacacatatacaatactagtgatgtctaccagtcctgctacttctggggtgcctgtctcctggaatggagctggaggagcaatgctgttggtgaataaatcagtctactggaactccaaggactggatgtaagcagatctttttttcctatagatgtctcagatgttcagttttcctgtcacaaggcttccagtctgtattagttcattttcacactgctaataaagacatacctgaaactgggaacaaaaaaaaaaaaaa

SEQ ID NO: 28291 - DNA, 3917 bp, Homo sapiens
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgtcgtttgcagaccgcgggcgccgatgtcgcccgcgccccgttaggatgagtctcgggtcgggcgaggagccgccgcagccgccgccgcccgagccgcgggcaggagcctcgggagccgccgccgccgccgccgccgcccggccgggccccgacgccgcccgcgcgcccccgggcccccgacacacatgagattcttcaggctcactttcaagtgcttcgtggactgcttctgactgcgccgcccgcgccccgcaccccgccgtccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttcc

SEQ ID NO: 28292 - DNA, 4138 bp, Homo sapiens
agactaggggcgagtttggagcaagtaactgtcagtgaggttgcagttggtctgggctgtttggctgtgagcgaaatagctgccccccacttctcacttgcacaccacgggatactcctcctgaggctccggatgattcagatggactgtgaaaaacaacaagatggatgatcatatggagattgcttctaacataaatctgcataaaaatttttctgaaacatggctggaatatttaaggagttttttttcagtactgaggacctccctgaagtcattctaacattgtctttgatcagctccattggagcatttttgaaccggcacttggaagactttccaattcctgtccctgtgatattatttttacttggatgcagttttgaagtattaagctttacatcttcacaggtccaaagatacgcaaacgccatacaatggatgagtccagacttattttttcgtatatttacaccagtagttttctttactactgcatttgacatggatacgtacatgcttcaaaagttattttggcagatacttttaatttcaattcccggctttttggttaattatatcttagttctttggcatctggcatctgtaaatcaattacttttgaagcctacccaatggttattattttcagctatccttgtgagttcagatcccatgctaaccgcagctgctataagagaccttgggctttctagaagcctcatcagtttaattaatggagaaagtctgatgacctctgttatatcattaattacatttactagtattatggattttgaccaaagactacaaagtaaaagaaaccataccttagctgaagagatcgtgggtggaatttgttcatatattatagcaagtttcttgtttggaattctaagttcaaaactgattcaattttggatgtcaactgtttttggtgatgatgtcaatcatataagtctcatcttttcaattctgtatctcatcttttatatttgtgagttagttggaatgtcaggaatatttactctggccattgtgggacttcttttaaattctacaagttttaaagcagcaattgaagaaacacttcttcttgaattctggacttttctatcacgtattgcttttctcatggtgtttactttctttggacttctaattcctgcacatacatatttgtatatagaatttgttgatatatactattcattaaatatctacttaacattgattgttttaagatttctgacccttcttttaataagccctgttttgtctcgagttggtcatgagttcagttggcgctggatattcataatggtctgtagtgaaatgaaggggatgcctaatataaacatggcccttctgcttgcctactctgatctttattttggatctgacaaagaaaaatctcaaatattatttcatggagtgttagtatgcctaataacccttgttgtcaatagatttattttgccagtggcagttactatactaggtcttcgtgatgccacatcaacaaaatataaatcggtttgttgcacatttcaacactttcaagagctaaccaagtctgcagcctctgcccttaaatttgacaaagatcttgctaatgctgattggaacatgattgagaaagcaattacacttgaaaacccatacatgttgaacgaagaagaaacaacagaacatcagaaggtgaaatgtccacactgtaacaaggaaatagatgagatctttaacactgaagcaatggagctggccaacaggcgtctcttgtcagcacaaatagcaagctaccagagacaatacaggaatgagattctgtcccagagtgctgtccaggtgttggttggtgcagcagaaagttttggtgagaagaagggaaaatgtatgagtcttgatacaataaagaattattctgaaagccaaaaaacagttacctttgctagaaaactactacttaattgggtgtataataccagaaaggaaaaagagggcccatcaaaatacttcttttttcgtatatgccatacaatagtatttactgaggaatttgaacatgttggataccttgtgatattaatgaatatatttccctttataatctcttggatatcccagttaaatgtaatctaccacagcgaattaaaacacactaactactgttttcttacactttatattctagaggcactacttaagatagcagcaatgaggaaggactttttttcacatgcctggaacatattcgagttagcaattacattaattggcatcttacatgtaatacttattgaaatagacaccattaagtatatttttaatgagactgaagtaatagtctttataaaagttgttcaattttttcgtatactacgcattttcaagctcatagcaccaaagttgctgcaaataatagataaaagaatgagtcatcagaagaccttttggtatggaatactaaaaggctatgtccaaggcgaagcagacataatgaccataattgatcagattacaagttctaaacagattaaacagatgttattaaagcaagtgataaggaatatggaacatgctataaaagagctaggctacttagagtatgatcacccagaaattgctgtcactgtgaaaacaaaggaagaaattaatgttatgctcaatatggctacagaaattcttaaggcttttggcttaaaaggaattattagtaaaactgaaggtgctggaattaataagttaatcatggccaaaaagaaagaggtgcttgattctcaatctattatcaggcctcttactgttgaagaagttctatatcatattccgtggctagataaaaacaaagattatataaacttcattcaggaaaaagccaaagttgtaacatttgattgtggaaatgatatatttgaagaaggtgatgagcccaaaggaatctatatcattatttcaggcatggtaaagcttgaaaaatcaaagccaggtttagggattgatcaaatggtggagtcaaaggagaaagattttccgataattgacacagactatatgctcagtggagaaataataggagagataaactgcttaactaatgaacctatgaaatattctgccacctgcaaaactgtagtggagacatgttttattcccaaaactcacttgtatgatgcttttgagcaatgctctcctctcattaaacaaaaaatgtggctaaaacttggactcgctattacagccagaaaaatcagagaacacttatcttatgaggattggaactacaatatgcaactaaagctctctaatatttatgtagtagatataccaatgagtaccaaaactgatatttatgatgaaaatctaatctatgttatcctcatacatggagctgtagaagattgtctgttacgaaaaacttatagagcacctttcttaattcctataacatgccatcagatacaaagtattgaagatttcacaaaagtagtgattattcaaactccgattaacatgaaaacattcagaaggaatattagaaagtttgttcctaaacataaaagttatcttacaccaggattaataggttcagttggaacattggaagaaggcattcaagaagaaagaaatgttaaggaggatggagcacacagtgccgccactgccaggagtccccagccttgctccctgctggggacaaagttcaactgtaaggagtcccctagaataaacctaaggaaagtcaggaaagagtaagactgttaagaagaccgaagcatgtattaatgctgtggctatgagaggcctcctgctgcagaaacacacttccctacatcaagaaggagtaacttcaggttggatcctgtgtggatgatcttggtgctaagcagaaaagaaatttggaccttgaaaccagcagttcaacatatatactttttgcaaaatttccttgatttaaaatatttgttattttaaatatacaaaacattttagaaaatcttagagtaaattttagtcttaaagccagaaaataagtttatagccatctagatattttgcatattgctcttacagcaataatggtttggttcactttatgaaaaataaaatgtattaaaatataaaaaaaaaaaaaaaa

SEQ ID NO: 28293 - DNA, 2740 bp, Homo sapiens
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaaacggcaacggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctactacgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaa

SEQ ID NO: 28294 - DNA, 2515 bp, Homo sapiens
ctctggaggcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggtgattttcagaaggaatatcaactgaaaaccattgagaagttggcattggaaaagagttacgatatttcatctggcctggtagcaatatttatagcattctatggagacagaaaaaaagtaatatggttkgtagcttcctcctttttaataggacttggatcacttttatgtgcttttccatccattaatgaagaaaataaacaaagtaaggtaggaattgaagatatttgcgaagaaataaaggttgtcagtggttgccagagcagtggtatatcattccaatcaaaatacctgtctttcttcatccttgggcagactgtgcagggaatagcaggaatgcctctttatatccttggaataacctttattgatgagaatgttgctacacactcagctggtatctatttaggtattgcagaatgtacatcaatgattggatatgctctgggttatgtgctaggagcaccactagttaaagtccctgagaatactacttctgcaacaaacactacagtcaataatggtagtccagaatggctatggacttggtggattaattttctttttgccgctgtcgttgcatggtgtacattaataccattgtcatgctttccaaacaatatgccaggttcaacacggataaaagctaggaaacgtaaacagcttcatttttttgacagcagacttaaagatctgaaacttggaactaatatcaaggatttatgtgctgctctttggattctgatgaagaatccagtgctcatatgcctagctctgtcaaaagctacagaatatttagttattattggagcttctgaatttttgcctatatatttagaaaatcagtttatattaacacccactgtggcaactacacttgcaggacttgttttaattccaggaggtgcacttggccagcttctgggaggtgtcattgtttccacattagaaatgtcttgtaaagcccttatgagatttataatggttacatctgtgatatcacttatactgcttgtgtttattatttttgtacgctgtaatccagtgcaatttgctgggatcaatgaagattatgatggaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtgattgcagatcatttgaggatcagagtgtgaaaaggagtttctcttttacagattctccaagatttgtttctgtgcccaactttcagaagaggaaaatcacacattatgtttacataagtagcaaaaatatatttatggtgatctgcattttcataataaagtgtcctattgtgaaaaaaaaaaaaaaaaaaaaaaa

SEQ ID NO: 28295 - DNA, 4266 bp, Homo sapiens
cgctttttccgcgggcgcttgataacgcgggtgaggcgtggagggcggcgccatggcccacctggagctgctgcttgtggaaaatttcaagtcgtggcggggccgccaggtcattggccccttccggaggttcacctgcatcatcggccccaacggctctggaaaatctaatgtaatggatgcacttagttttgtaatgggagagaaaatagctaatttaagagtgaaaaatattcaagaactcattcatggagcacatattggaaaacctatttcttcttctgcaagtgtaaaaattatatatgtggaggaaagtggcgaagagaaaacatttgcaaggattatccgagggggatgctcagaatttcgctttaatgataatcttgtgagtcgttctgtttacattgcagagttggaaaagataggcataatagtcaaagcacaaaattgtttggtttttcagggaactgtagagtcaatttcagtgaagaaacccaaagaaaggacccagttttttgaggaaatcagcacttcaggagagcttataggagaatatgaagaaaagaaaagaaagttacaaaaagccgaagaggatgcacagtttaactttaataagaaaaaaaatatagcggcagagcgcagacaagcaaaattagagaaggaagaggcagaacgttaccagagtctccttgaagaactgaaaatgaacaagatacaactgcagctttttcaactataccataatgagaaaaagattcatctcctgaacaccaagttagagcatgtgaatagggatttgagtgtcaaaagagagtctttgtctcatcatgaaaacatagttaaagccaggaaaaaggaacatggaatgctaactagacaactacaacaaacagaaaaagaattaaaatcggttgaaacccttttaaatcagaagaggcctcagtacattaaagccaaagaaaacacttctcaccaccttaagaaattagatgtggctaagaaatcaataaaggacagcgaaaaacaatgttctaaacaggaagatgatataaaagccctggagacagagctggctgatttagatgctgcatggagaagttttgaaaagcagattgaggaagaaattttacataaaaagcgagacattgaactggaagccagtcagctggatcgttataaagaacttaaggaacaagtaagaaagaaagtagctacaatgactcaacaactggaaaaactgcagtgggaacagaagacagatgaagaaagactggcatttgaaaagaggaggcatggagaagttcagggaaatctaaaacaaataaaagaacaaatagaagatcataaaaaacgaatagagaagttagaggagtatacaaagacatgcatggattgcttgaaagagaaaaaacagcaagaggaaaccctagtggatgaaattgaaaaaacaaaatcaagaatgtctgaatttaatgaagaattgaatcttattagaagtgaattgcagaatgctgggattgatacccatgagggaaaacgtcagcaaaagagagcagaggttctggaacaccttaaaagactgtacccagattctgtgtttggaagactatttgacctgtgtcatcctattcataagaaataccagctggctgttactaaggtttttggccggttcatcactgccattgttgtagcctctgaaaaggtagcaaaagattgtattcgatttctgaaggaggaaagagctgaacctgagacattcctcgctctagattaccttgatatcaagccaatcaatgaaagactaagggagcttaaaggctgtaaaatggtgattgatgtcataaagactcagtttcctcagctgaagaaagtgattcagtttgtgtgtggaaatggtcttgtttgtgagactatggaagaagcaaggcatattgcactcagtggacctgaaagacagaaaacagtagctcttgatggaacattatttttaaaatctggagtgatctctggagggtcaagtgacttaaaatacaaggctagatgctgggatgagaaagagttaaagaatctaagagacagacgaagccagaaaatccaagagctaaagggtttaatgaagacactccgcaaagaaacagatttgaaacaaatacagaccctgatacagggaactcaaacacgactcaaatattcacaaaatgaactagagatgattaagaagaagcaccttgttgctttttaccaggaacaatctcagttacaaagtgaactactaaatattgagtctcaatgtattatgttgagtgaaggaatcaaggaacgacaacgaagaattaaagaatttcaagaaaagatagataaggtagaagacgatatcttccaacacttctgtgaagaaattggcgtggaaaatattcgtgaatttgagaacaaacatgttaaacggcaacaagaaattgatcaaaaaagattagaatttgaaaaacaaaaaactcggcttaatgttcaacttgagtatagtcgcagtcaccttaagaagaaactgaataagatcaacacattaaaagaaactatccagaaaggtagtgaagatattgatcacctaaagaaggctgaagaaaactgtctgcagacagtgaatgaactcatggcaaagcagcagcaacttaaggacatacgtgtcactcagaactccagtgccgagaaagttcaaactcaaattgaagaggaacggaagaagtttctggctgttgatagggaagtggggaaattgcaaaaagaagttgtaagtattcaaacttctctggaacagaaacgattagagaagcataacttgctgcttgattgcaaagtgcaagacattgagataatccttttgtcggggtcactggatgacatcattgaagtggagatgggaactgaagcagaaagtacccaggcaacaattgatatctatgaaaaagaagaagcctttgaaatagactacagctctctaaaagaggatttgaaggctctacagtctgatcaagaaatcgaggcccaccttaggctcttattgcagcaagtagcatcccaggaagatatcttactgaaaacagcagccccaaacctacgagcactggagaacttaaagactgtcagagacaagtttcaagagtccacagatgcttttgaggccagcagaaaggaagccagactgtgtaggcaagagttcgagcaagtgaaaaaaaggagatacgatcttttcacccagtgttttgagcatgtctcaatctcaattgatcaaatctacaagaagctctgcagaaacaacagcgcccaagcatttcttagcccagagaaccctgaagaaccttacttggagggaattagctataactgtgtggccccaggcaaacggtttatgccaatggacaatttgtcagggggagaaaagtgtgtggcagccttggctctcctgtttgctgtgcacagttttcgtcctgccccattctttgttttagatgaagtggatgcagccctagacaatactaacataggcaaagtgtcaagttacatcaaagagcaaactcaagaccagtttcagatgatagtcatctccctaaaagaagagttctattccagagccgacgcgctgatcggcatctatcctgagtacgatgactgcatgttcagccgagttttgaccctagatctttctcagtatccagacactgaaggccaagaaagcagcaagagacacggagagtcccgctaggggcagtcctgcagcagtcacctgatcactgttcagttcccactctaatactcacacagctcctccacaggagacttctggagcaagcaggaccagcctggtgcaccctttaagagaaaccttagtcgttctagccaaagaggctgtggctcactttagttgagtgttcagacctcattctagtagggaaagttttcagtgagagctggtgtcaaatgagtttttaaaaaacaaacaaaaggtacaattttgtactataattctaacttctattttgaaataagctagtttggttggaaaaattttgaattcagcttcatcttcactctgatcttgccttgcacccaagtaatcttgaagggaacttctcttggtttttaaacatactagttataagattgttaataaactgttgaacctggcttttgggaaattgtttcagagaaactatgttagtattgaaaatatcaataaaaaatgttctaatttcaaaaaaaaaaaaaaaa

SEQ ID NO: 28296 - DNA, 2307 bp, Homo sapiens
cgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaac

SEQ ID NO: 28297 - DNA, 2148 bp, Homo sapiens
cgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaac

SEQ ID NO: 28298 - DNA, 2863 bp, Homo sapiens
ggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgagccagtcgtttggtggaggagggtccttcccacacctttgtttaggagtcatcattcacacacacacacacacacacacacacacacacacacacactctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagctcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatacccacagcctccataggcaaggtgagctttctgtgctacccactggttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcaga

SEQ ID NO: 28299 - DNA, 2650 bp, Homo sapiens
ggagaaggcgagcgcggcagtcgcgccggcgctgggcgaggaagcggagccgggccgcctccggaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcactcttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtactggggaccaatcacacgttgggaggcagaagggaagctagcaaacgtgccagatggttcttttcttgttcgggacagttctgacgaccgttaccttttaagcttgagctttcgctcccatggtaaaacacttcacactagaattgagcactcaaatggtaggtttagcttttatgaacagccagatgtggaaggacatacgtccatagttgatctaattgagcattcaatcagggactctgaaaatggagctttttgttattcaaggtctcggctgcctggatctgcaacttaccccgtcagactgaccaacccagtgtcccggttcatgcaggtgcgctcgttgcagtacctgtgtcgttttgttatacgtcagtataccagaatagacttaattcagaaactgcctttgccaaacaaaatgaaggattatttacaggagaagcactactgaaagattgagaaccctgcatcttgcactttgggaataagaacaagagattgaaatacagtttacaaactttcattgccatcaaaatcttttgctgccataactatttcagttttatgtgtaaaagagtcatcagtttgtttaggggtggggaagtgtcagcaaggtgtcttgggtttattttggttctttaaaaaagggaagtcttgaggttttagaggtgtgaattatgtttcatcaatgtgcagaataatcacaatgtgaattatcaaattctcctcaatgccccccccgcccagtcctttgctgctatccactgtgatttttatgcattaaaagcacatttcatgtgtattcaaccctaagtaaagttgaatgaaacttaacagaatggaaattgctatgtctttttaaatggtccattttcaaaagacagtgttgaataaacatacctgtgtgataaaacacagaatttacatatacactgaagatgagtttttaatctcttactttaaaaagatttatttagaatcgtgaattgacataatcttgggtaatggaacggagatctgcaacatatcttttaacaacacttttttctaaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatgaaaaaaaaaaaaaaaa

SEQ ID NO: 28300 - DNA, 5757 bp, Homo sapiens
atcaccctctggacaagagaacgggcgagcgggagctaggagggaagagtggagaggaccggcgaggcgcgccagccggagccacctccttcccggccgccccctccccactccccctacacacacacgctcgctcgctcgccggcgcgcgcacaccccccgcgccggacccgcacctcggcgggcgccacacactcggcagcccgagccgcggtagccgcagcgggatggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtcatacttatcctgacgaagctgtatgacttcaacctgggcagcgtgactgagagttcactatggaggtcgacagattatggcaccacctatgaaaagctgaatgacaaagtgggtttgaagactgtcctcagttacctctatgtcaatccaaccaacaaaaggaagattatgcttctcagtgatcctgagatggagagcagcatattgatcagctcagacgaaggggcgacctatcagaagtatcggctcaccttctatatccagagcctgctctttcatcccaagcaagaggactgggtgctggcctacagtttggatcaaaagctctacagctccatggactttggaagacggtggcaactcatgcatgaacgcatcacacccaacaggttttattggtcggtggccggattggataaggaggcggacctggtgcacatggaggtgcggaccacggatggatatgctcactacctcacctgcaggatccaggaatgtgccgagacaactagaagtgggccttttgcccgctccattgacatcagttccctggttgtccaggatgaatatatcttcattcaggtaacaactagtggaagagccagctactacgtgtcttatcgaagagaggcctttgctcagataaagctgcctaagtactcgttgccaaaggacatgcacatcatcagtacagacgagaaccaagtatttgctgcggtccaagaatggaaccagaatgacacgtacaacctctacatctcagacacgcgtgggatttacttcactctggccatggagaacatcaagagcagcagaggtctaatggggaacatcattattgaattgtatgaggtagcaggtatcaaagggatatttctggcaaacaagaaggtggacgaccaggtgaagacatacatcacttacaacaaaggcagggattggcgcctgctgcaagctccggatgtggacctgagaggaagcccagtgcactgcctgctgcccttctgttccttacatctgcacctgcaactctctgaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgacagtttttggccacttcagcctccgctccgaatggcaattggtgaaagtggactacaaatctatcttcagccggcattgcaccaaggaggactatcagacctggcacctgctcaatcagggagagccttgtgtcatgggagaaaggaaaatattcaagaaacgtaagccaggagctcagtgtgccctgggccgagaccactcaggatcagtggtctcagaaccctgtgtctgtgccaattgggacttcgagtgtgactatgggtatgagagacatggggagagccagtgtgtcccagctttctggtacaatccagcatccccatcaaaggactgcagccttggtcaaagctaccttaacagcactgggtatcggcggattgtgtccaacaactgcacagatgggctaagggagaagtacaccgccaaggcccagatgtgccctggaaaagcccctcggggcctccatgtggtgacgaccgatgggcggctggtggcagagcaggggcacaatgcaactttcatcatcctcatggaggagggtgatctacaaaggacaaacatccagcttgactttggggatgggattgctgtgtcctacgcaaacttcagccccatcgaggacggcatcaagcacgtgtataagagtgcggggatcttccaggtgacagcctatgcagagaacaaccttggctcagacacagctgtcctcttcctgcatgtggtttgtcctgtggagcatgttcatctccgagttccatttgttgccataagaaataaggaggtcaacatcagtgcagtcgtgtggcccagtcaactggggacccttacctatttctggtggttcggcaatagcacaaagcctctcatcactttggacagcagcatttccttcacattccttgcagaaggaaccgacaccatcacagtccaggtggctgctgggaatgccctcatccaggacacaaaagagattgcagttcatgaatatttccagtcccagcttttatcattctctcctaatctggattaccacaatcctgacattcctgagtggagaaaagatattggcaatgtcatcaagcgagctctggttaaagtaaccagtgtcccagaggaccagatcctcattgccgtgtttcctggtctccccacttcagcagagcttttcattcttccacccaagaacctgacagagaggaggaaaggcaatgaaggggacctggaacaaattgtagaaacactgtttaatgctctcaaccaaaatttggtccagtttgagctgaagccgggggtacaagtcattgtgtatgtcacacagctgacgttagctccattggtggactccagtgctgggcacagcagctcagccatgcttatgctattatcagtggtatttgttggcctggctgtgtttttgatctacaagtttaaaaggaaaatcccttggattaacatctatgctcaagtccaacacgacaaggagcaggagatgattgggtcagtgagccaaagtgaaaacgcccccaaaatcacactcagtgactttacggagcctgaggagctgctggacaaagagctggacacgcgggtcataggaggcattgccactattgcaaacagcgaaagcacaaaggagatccccaactgcactagtgtttaataccagcaagccacgtggtcaaccacctttctgactttttatttttgatgattactattactattattatggaaaaattaaaatgtcttttttaccttttgtttaccaagggccccttcataaatagcaggcaaatgcctagctttgggagaaaagggcattcttagctgattgaaatgagacaaagggaataaatggctgtatttgtgctaagagcaaaggatgcatcttcccacagcctcctcgctttactctgccattggtagcttaaagactttctttttccttgtggtctcccttttttcaaaattgaagttgggttggctctttgtgaacctctcatccccacagcagaatcaccaacactctccgcttcccccagcacacacacatacaacacagatcatttcccagttagatccgcaggaagtaggttggtgggggtggatgtagctgcagaaagcatgcacaactttgtgaaagaggccctgccttgtgcatgtccatagtgaggctacagatggcttattgtatataattacaatgtaaatagctttttatttcctaagaaataatttaatgtttagtaaaaaagaaaacagaaaaaagaaagatgcgtgtgttggcttacgcactggccctcagagctgaccaacccgccaggcctgctcaatgcattgggtttggatgctctcctgttgtctgtcacacttaactcttgcatctccttgtccatgccatagctggtttctacttatgtatataaaggggggtggggggaggggcttctctggggcaattgataaaggaaggactctagtgacatcatagaacatggcagtcgtttttgttccaagaatgatatgaaaggtgaagaagaggcccactagaggcttcatactgagacccagatgggggaaaacagcttcctctctaaaaggaaaaacttgatatttatcagtctgagaaaatatttttttctaaagaaggcagtcagtggatcttaaaatgacaatctgtttttaaattggattctatgaaaatgcataatgcttatggtgaattctcaggctattctgagctcagaaaagtcccctgggcactaggtaaagcccagtgaatgtctcttggcatgggaggagttaaagaggttggaagggaagaggcatttgtggaattatgagttcatgcaaaactctccaggccaagtaggggtctagcctttaatgatattagtcaaaggcaattttagcaaagctgtgctatttgcttgtcagatgtacacaacttccttaaagtcaaatgtctgccttcagttcccttaaggtagttcttgcctctggggtgagtggctttcaaagccttttagcttttccagcacctcagccccttcacacatttacacataccaatttttttcaatagggtcacgttaagccatgctgtaagcattgtttttattttcaggcttagcctgagcacacttatttttgaaaatgatataatgtatatatatgggaggaaaggccacattttgtacctgttaatttttgtgggatgttgttcccattcttctttgtgagacagagagaatgtgatatagagaaatctggctggctacagtgtagatcagtattaggaatatttctaaagatcctgcttttttgtttcaagggttaaatggggcagacaattgcaatacttgtactaaacactggaatacaaatgcatgactcatatctatatatacagtatatgtacatatactgttcttggttttattgttccacttgaatatttctactgtaaaaaaaagacagtggttttgaaattgttgaaaataaatgtatttttgtacatc

SEQ ID NO: 28301 - DNA, 954 bp, Homo sapiens
tcgccccttctcggccgccgtagttttttttttttttaaagaaaaaacggttacccagcaactagaaaaacaaccggaaccggcggcaccagctcggagagaaaggaggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcaagaaccacctgagaaaagtgatcctaaacaagaagagtctcagatatctgggaaggaggaagagacatcagtcaccatcttagactcttctgaggaagataaggaaaaagaagaggttgctgctgtcaaaatccaagctgccttccggggacacatagccagagaggaggcaaagaaaatgaaaacaaatagtcttcaaaatgaggaaaaagaggaaaacaagtgaggacactggttttacctccaggaaacatgaaaaataatccaaatccatcaaccttcttattaatgtcatttcttcctgaggaaggaagatttgatgttgtgaaataacattcgttactgttgtgaaaatctgtcatgagcatttgtttaataagcataccattgaaacatgccacttgaagatttctctgagatcatgagtttgtttacacttgtctcaagcctatctatagagacccttggatttagaattatagaactaaagtatctgagattacagagatctcagaggttatgtgttctaactattatcaaatgaataaatcctctctatcacatcccccaaaaaaaaaaaaaaaaaaaa

SEQ ID NO: 28302 - DNA, 794 bp, Homo sapiens
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccgggaggctcgaggaccctcatttaggatctgtgtggactttttagggcctagatgggccaggggatgttccaccgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 28303 - DNA, 755 bp, Homo sapiens
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccaccgggaattagaaataccatctgccgtatgcagcaagggatctgcagactttttttctgccattctgggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatgtccacccc

SEQ ID NO: 28304 - DNA, 718 bp, Homo sapiens
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccaccgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 28305 - DNA, 677 bp, Homo sapiens
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatgtccacccc

SEQ ID NO: 28306 - DNA, 530 bp, Homo sapiens
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagaacctgcatcagatttaaaagttgttgactgcaggagaagtgaaggcttctgccaagaatactgtaattatatggaaacacaagtaggctactgctctaaaaagaaagacgcctgctgtttacattaaaactgatgttgctgatataga

SEQ ID NO: 28307 - DNA, 520 bp, Homo sapiens
catatttgtgctccttcacgggagggcagggaggttcaacggaccttaaaacatgaaggtcttttttctgtttgctgttctcttttgtttggtccaaacaaactcagtgcacatctctcaccgggaggctcgaggaccctcatttaggatctgtgtggactttttagggcctagatgggccaggggatgttccaccgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 28308 - DNA, 444 bp, Homo sapiens
catatttgtgctccttcacgggagggcagggaggttcaacggaccttaaaacatgaaggtcttttttctgtttgctgttctcttttgtttggtccaaacaaactcaggggatgttccaccgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 28309 - DNA, 1267 bp, Homo sapiens
acttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggattctggatgttttctattcacttaccatcgaaaatgaaagtctggcaggatgacagcataaatggtccactgcagagcttgaggttgtaccaggagaaggtgcgacatcacagtggggaaatccaggacctccgaggtagcatgaaccagctcattgccaagctccaggagatggaagccatgtccgatgagcaaaaaatggcccagaaaataatgaagatgatacacggagattacatcgaaaagccagactttgccctgaagtctataggggccagcattgactttgagcacacgtcagtcacctataaccatgagaaggcccactcctactggaactggatccagctgtggaactacgcacagcccccagacgtgatccttgagcccaacgtgacacctggcaattgctgggcctttgagggtgaccgcggccaggtgaccatccaattggctcagaaggtttacctgtccaacctcacgctgcagcacatccccaagaccatctcattgtcaggcagcctggacaccgcccccaaggacttcgtcatctatggcatggagggctcccccaaggaggaggtgttcctgggggcatttcagtttcagccagaaaacatcatccagatgttcccactccagaaccagccggcccgggctttcagtgcggtcaaggtgaagatctcaagcaactgggggaacccaggcttcacttgcctgtaccgcgtgcgagtgcatggctctgtggccccgcccagagagcagcctcaccagaacccctaccctaagagagattaaaatttattctttacccccaaaaaaaaaaaaaaaa

SEQ ID NO: 28310 - DNA, 758 bp, Homo sapiens
ggggatcccactgggaagcttcaacatagctgtggaagtctgcagtctacaggagcctactatagacattctacaaccaaccagaatcatggaacagccaacttccagtaccaatggggagaagacgaagagcccctgtgaatccaataacaaaaaaaatgatgagatgcaagaggtaccaaacagagtcttagcccccgaacagagtttgaagaagacaaaaacatcagaatatccaataatatttgtgtattacctcaggaagggtaagaaaataaattcaaatcaactggagaatgaacagtcccaagagaactccatcaatccaatccaaaaggaggaggacgaaggcgtagacttatctgaaggatcttcaaatgaggatgaagacctaggcccatgtgaaggaccttcaaaggaggacaaagatctagactcatctgaaggatcctcacaggaggatgaagacctaggcttatctgaaggatcttcacaggacagtggggaggattagtcacacatggagaaaccaaattggacaaatcatcaccactgatggcgatgattacaataaaatcaagtttaaggagctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaa

SEQ ID NO: 28311 - DNA, 2070 bp, Homo sapiens
gggggatcaggcctcgcagtgggacgttgggaagccggtgttggcagatgctgtggctgggaggagtccagacgttcgccctgtcccgcggggctgagccacaactgcttaggagttttgggcaggatcgatggatgcaggaagcagtaggagtttggagaatgcagtgaataggatctatcatgatcagcttgttccaaagataaacacaagcaagaaaatgtccaccttagcgcacccacctaacatcctggaaatgtcacaagagattaagaaaaactgtggaggtaaacaggtagaaatcacacttgaaagaacaaaaatgacaaagggcatcaaagaaaaacaaagcaatgatttagagaaagcagcctttaaacggaaggcagaaggtgaagaaaagccaactagaaagaaacaggcaaagataacagaacttgacaatcagttaatcaccatgcctctgcctcacatccccttaaagaacataatggatgtggaaatgaagttggtctacattgatgaaatgggtgttcgctatgagtttgtagagtccttcatgtctactgggagtcagccaacatgccaagctgctgaaatagtagaccctttgagtgtacataatttcagctttctgcctcagattgacaaatggcttcaggtagccttaaaggatgccagctcttgctatagacaaaagaaatacgccttggcagcaggacagttcagaacagcacttgagctttgcagcaaaggagcagttctgggagaaccatttgatgcacctgctgaagatatagcaagtgtggcaagtttcattgagacaaagcttgttacctgttatctacggatgaggaaaccagatcttgccctgaatcatgcacacaggagcattgttttaaacccagcctatttccggaatcatcttcgtcaagcaacagtgtttagatgtctggagaggtattcagaggctgcccggagtgccgtgattgctgactacatgttctggcttggtggaggaagggaagagagcataagcaagctcatcaaactgtattggcaggccatgattgaggaagccatcaccagagctgaatctttctcggttatgtacacaccatttgcgacaaaaataagagctgataaaatagaaaaagtaaaagatgctttcacaaaaactcatcctgcatatgcagagtatatgtacacagatcttcaagcactccacatgttgcctcagacagttgactggtcatcttttcctccccaacaatatctcttgactcttgggttcaaaaacaaagatgatggaaaatttttggaaaaaatatcaagcaggaagctgccgatattcacagagcataaaacacctttcggtctgaccagagaagatacagtgaggcaaatggagacaatggggaagcgaatcttgccaatattggattttattagaagcacccaattgaatgggagttttcctgcatcctcaggtgtgatggagaagttgcaatatgccagcctcctcagccagctgcagagagtaaaggagcagtcccaggtgattaatcaagcaatggcagagctagcaaccattccctacctacaggacatcagtcaacaggaggcagaattgctgcagtcactaatggcagatgctatggacacccttgaaggaagaagaaacaataatgaacgtgtgtggaatatgatccaaaaggttggacaaattgaagattttctataccaattagaggacagtttcttaaaaactaaaaaactgagaactgctcgaaggcaaaaaacaaaaatgaagcgacttcaaactgttcagcaaaggtagtcattagggagcaggcactaccactaagatatcccagaagaagaggcaagggcatccactccaatgcccacctagtactgtgaagctggataacaaaagcttgtcaccaaaagaaagaggtggtattcccctcagttcatctttaccaaagacactctatgtttcattaatctcaactggcagcaataaatattctcagcaagttggactcgaaaaaaaaaaaaaaaaaa

SEQ ID NO: 28312 - DNA, 4317 bp, Homo sapiens
agcgggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgatctggttgaaactgaaaagaatcttgaagaaagcaagaacagatcggccatatcccttttggctgcagaggaggaaataaatcagctgaaaaagcagcttaaatctcttcaagctcaggaggatgcccgccacagaaacacagatcagaggagctcagagaataggcggtcagagccttggagcttggaggagcggaagcgtgagcagtggaactcactcaagcagaatgcagaccagcaggacacagaagccatgtccgattataagaaacagctccgaaacctgaaggaggagatagctgttctgtctgctgagaaaagtgcactccaaggaaggtcctccaggagccggtctcccagccctgcccctcgcagccgtagctgcagccgcagcagatctgccagcccctccaccgctgtcaaggtcaggagaccgtccccaaaccgctccaagctgtccaatgtggcgcgcaaggctgccctcttgtcccggttcagcgattcctattcccaggcccgcctggacgcgcagtgcctgctgcggcgctgcatcgacaaggctgagaccgttcagcggatcatctacatcgccacagtggaggcattccatgtagcaaaaatggcattcagacacttcaagatccatgtgagaaaatcgttgacaccatcttatgtggggtcgaatgactttgagaatgctgtcttggattatgtcatttgtcatcttgatctatatgattctcaaagcagtgtcaatgatgtgatccgagccatgaatgtcaatcccaagatttcattccctcctgtcgttgacttttgccttctcagtgacttcatccaggagatatgttgcattgcctttgcaatgcaggccttagaaccacccctagatattgcatatggagcagatggagaagtttttaatgattgcaaataccgccgcagctacgactcggatttcactgctcccttagtcctctatcacgtgtggcctgctctcatggagaatgactgtgtcattatgaagggagaagctgtcaccaggagaggggctttttggaattcggtgcgatctgtaagtcgttgtcgaagcaggagtttaagtcccatttgcccccgtagccaaattggtttaaacacgatgtctcgaagtcggagtccttctccaataagatgtggattgccaagattttaaaagcaccagacctgctcctttgacccagtgcgtggaaacagctgctttctccagtgccgccatctgtcttctgtgtctgcctcagacctcacttaagataatgtcaaaaggcaattctgtgtatcaccccacacagagagttaaatgttttggcttggcgcatttgtaactttagatatattgcattctattttattttatagatactaattccattaatttcataaaaatgattgtataggcatttaggatcatattcattcgaagcaaagtccgttacaaaggttcaagatttccatctcaaaacactacgctcttttatgggaactgtgtgaactgaagtggaaagcatctaccatgctgaggctaaaagaaaagatgaatcattttagtttgcagatggatcgtaaatataattgttggtatcagctttagctcaaaaccaatattaggtgttttaatttccttttaaggtttggaagacagccctaatctcaggttggggagctcatgttagtagcagtgacttaaggctaagtgtagaagataatttaagatacattttctttatatattagccaacaaattatatttattggttggcttgcttttccgttctgattttgagagtgcccagtttggtttagttgaccaatgaatgtcaaagctacttagttgagagaatttccttgttcataaatgtagagcagtgatttgattagaagccagctttgagataaatgttaattacctcatgcatatctcctgggaatatttcaaactgttttaatgcatgtgttatatataaaagtttcttgggacatgctcttcacctgttctacctagttatttgcaaattcagacctcctattgaactctgtctgaccaaaactacttaaactcaaggcccaaaactaggggcaccatttactgattttaaattgagtatatatcccttgacttcttcactgtcaaatacttttgaaacttcacgttcaagataagaatggaatgttgctttcttgcaataagtaatgttctttctgcctttttttcacttttaagtcagccttaaacacatgcctcacaaacatctactttctccacatacctttgagagagacactgaattggcctcagctcagttttgcataagcttagtgccagaaccagcacctgatgcttttcaggtgaaaataaaacaaacagcttctctaaagcatcttacccctgtgctggaggtttgagggacctcttcagtgcctgccccttgagtctaatggtcaccacctcattctgaagtatgagttgaattttttgccctctttgcatatttacattagtcatcactttgaagcaatgcagtgtgctggaaggagcactatctgcctaggtaactgctagtcatgacctggtcatcagcttgctttgtggcactgagcaagttacttcacttctctgagccttggttttatcatagggtgaggaggttggatacaattagtgccccccttaaccctgcagactcaatgttcccttttataacaagtattttattctgaatatgaaatgaaaattaaagttaatataatcatctatgtgcatgtataattttaagcagtgaacatagtaccctaactataatataaagcagaaaaaaaggcaacttttaataaaataaaatgtatttcaataaaaaagcttgggtataaccaccctagaagataaaattaagtcattagatggctgaacctgcatgtagagccaccagctacaaatgaaaatcaatgtgtgtattggcaacagaaaatcacggtgttgtcattggatgtgactttctgaagtggtgggcaattcttgttaatgttttaaacaaaaaaaaaaacaccttacagtcttgccctgatttacacagcagtcacattcctggaaaattcaagtgtttattaaaactatgcaacagttactgtgtgttatacgttgaaaggtcttcactaatatctcactaagtaatgagaatgcctacatatcagaattttttttttcaggagccaagcacatatactgatttggaaaaaggcacaggtagctcagtttatttgctttctaccctgcctggccacttgctgtttcttcagtttctaatttgagctgtaactacacaaggaaagctaaatagtctggaaaatttttggaaagaatccacaaagccaaaggagactggcctatactcattttatctggggatgtaccttacccttagagactttgaaaaatgtgaagctcttattttgtaacctgggtaaatgttagtttctagattttcggcttaacatctaataataacatttaaaaagtgcttttgtaactattagttatttgcaataaaatgctttccttctacaaaaaaaaaaaaaaa

SEQ ID NO: 28313 - DNA, 1473 bp, Homo sapiens
gggggagggaaactgagggcgaaagttgtgtgtcgtgttggcaggagggcctagaagggaaagactgtgcgttgataccaaactgcccccactccgtgggcgggtcaggagaggcctttggaagagcgtctcaactcggactggagcctcttctctcccaccgcggtctagtgagacaatgtcatattataaatttggaatgctgaatagaaaattatagattttgatattgaaggaaatgaagcgaagcctaagtgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagcttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagtagttttctgttattgcttaatttaccatctccatagttttatagctactattgtatttcacttgttgaattaaagtatttgaattcttttaaaaaaaaaaaaaaaaaa

SEQ ID NO: 28314 - DNA, 1044 bp, Homo sapiens
agcgtggctctttggagcacccacttcacttctcccatgtagttcctgagtgcaggactctcctgaagaaggggcgtctaaaaggccagcccatgcatcttgttcagaccaggctgctccatctccgctaagcccagggatccacttgtgtgtctttctgggataattgtctttagtggcagcctgggcctcggggaaggaagggcatgaggaatggccccggctgggatgtcaggggcccaggacaactcctgtctctaccaggaaattgccccctcttttcagaggctgccttgtcctagaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttgaagtttctgtcctaccagtgccacagctccctctcccacttctgaactacctccaagagagaccatcctcagcagcctagtatgttatgctagtcctggaatggtgtattctggatgtctactcaaggccaaaccccagtattgcctttcgtttccctattcaaggccaaggctagattctcttcattgtctccatttctctttctccagagctcctatagggcaagacactgtttctcatatatttctggatccttggagcttagctcggagcttggcatacatgcccagcatgaacttttctgaataaaataatttcaaatgctgtatacaggaaaaaaaaaaaaaaaa

SEQ ID NO: 28315 - DNA, 1209 bp, Homo sapiens
gaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttgatgacgatttaattcaagatttcttgtggatggactgctgctgtaaaattgcagacaagtatcttttggctatgacctttgtttatttcaagagggctaaatttactataagtgagcataccaggataaatttctttattgctctgtatctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggaggttatggccattgcaccaacccattatatctggcaaagagaacgttctgttcatcacagtggagctgtcagaaactacaacagagatgaagttcagctgccccggggacctagtgccacaccagtagattgttcactctgtggtaaaaaaagaagatatgttagactgggattgtcttcatcatcatctttatccagtcatacagcaggggtgacagaaaaacattctcaggactcatacaactcactgtcaatggacataataggtgatccttctcaagcttatactggttctgaaggtatgatttagtaatatgccagaattagatttatgcatgttgtttactgagctctagtcagtcctttctggcggggatacataataatttatatactccaacaatatgagttaaattaatcttgaaactttctcccctttcagttactttttgtcttgtgtccatatttgttttgtggtgacccacctaaacagatttttaatgtgacctatgttaagttgaaaactaatgcaccataagcctcagtattttaagagcctgaatcatttttttgaaatgtttattttattcaaaagggtttcaagaagaaaataaatttacttgtaatctcaccttccaaa

SEQ ID NO: 28316 - DNA, 1813 bp, Homo sapiens
agcgaccgacgagcaaccgtctgaggccaggagcgctgcgacggagccttgaccgccgttgcccggccctctcccgcgcagccccgggcttccgcagtccttccttcagaagggaaatttctgagggtcaggaaggggaatctgtacctcactccttgaacaccaaggaaggaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttgatgacgatttaattcaagatttcttgtggatggactgctgctgtaaaattgcagacaagtatcttttggctatgacctttgtttatttcaagagggctaaatttactataagtgagcataccaggataaatttctttattgctctgtatctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggaggttatggccattgcaccaacccattatatctggcaaagagaacgttctgttcatcacagtggagctgtcagaaactacaacagagatgaagttcagctgccccggggacctagtgccacaccagtagattgttcactctgtggtaaaaaaagaagatatgttagactgggattgtcttcatcatcatctttatccagtcatacagcaggggtgacagaaaaacattctcaggactcatacaactcactgtcaatggacataataggtgatccttctcaagcttatactggttctgaagtagtcaatgaccatcaatcaaataaaggaaagaaaactaatttcttgaagaaagacaaatctatggagtggtttacaggaagtgaagaatgagatggcccaactaaaccaatttggaatcattaactacaaaatgtcaaactaactgcaagacaagtgtcaaaatgggatgtttaagcagttttgctatgttatacatcttttagttgttattttcaaaattatatgtataagttatataagtcatagtaatagctaaaaatgccaatctatggaagcagtgattttcaatataaagttctattttgatatttttccatcttcaagtcagttactgtcatctggagtactcagttaagttgtggtttgaccttcctcaacttgacaagaaaagctaatttaagagaagaaaaacataaagtcattatattaattaaaagaaaaaacaccatttaatatgttctgaaaacattactcacctgtatgaccaggttgccagtgtactggtctagcaacatagggaaatgatccatatggaaaatcagaatgcgattcttctgttgtaaaaaaatatatgtactataagctacataaaatattttctatttttttcacaaaactgttaaaatatgagttactctctttattgtaagttttttctttatttatttccttgcatatgttttagagctactctgccagttattatacagaaactatttgtcaatgattatgtaataaacatatgattttataaccaaaaaaaaaaaaaaaa

SEQ ID NO: 28317 - DNA, 594 bp, Homo sapiens
ggggagcgctccctgcgagtggcgcaggtaacagaccgcaggggcaagacagccggcgcgggaggaggatggcgctgtcggtgctgcgcttggcgctgctgctcctggcagtcaccttcgcagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcatt

SEQ ID NO: 28318 - DNA, 1961 bp, Homo sapiens
ggaaccaccagaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccagggaaacaataacaacttccaatccaaagccaactgcctgaacacctgcaagaataaacgctttccctgattggataaggatgcactggaagaactgccagaatgtggctcatgctctgagtactgttcctgtacctgacggatgctccagactggcttccagtttcactctcagcattccaagatcttagcccttcccagaacagaacgcttgcatctacctcctcttcctccatctttggctcttttgatgcacaatatccatccgttttgatttcatctttatgtcccctttatctccaacttctagaactcccagtttatacctgtgtcactctcaattttttccagtaaagtacttgatgtagtcctgtgccttgaggctgagtgattgacatctttttggcacattacactttgcagagtaagggatcattgaggcttctggtgacatcattcaagggagtgaagacaatcagaactttgagagttcagagttccaggaatattgttattgttatcttcctctgtttctacaaaagattgtaaaaccctttttaggcaagggcccaaggacagtgccttagtttggatcctctagaaactaaccctgggaaaagggcatgggtgcaggtagtttgtttgagagatttcccaggacatacaagatggggagtgagatgagtaattcagggaagagaagggaagagagaagagtctattatgagctggttactactgtggctcaatcctattggggaccttttaaagaatcatgtaaaacaggcttacaaattttctttttaaaaatattttattttattttacgttccgggatacatgtgcaggacctgcaggtttgttacataggtaagcctgtgccatggtggtttgctgcacctatcaacccattacctgggtattaagccccgcatgcattagctatttatcctgatgctttccctccccctgccccctcaacagtccacgtgttctcattgttcatctcccacttgcaagtgagaacatgtggtatttacttttgttcctgcgttactttgctgaggataacggcttccagcttcatccatgtccctgcaaaggacgtgatctcatttctttttatggctgcatagtattccatggcatatatgtaccacattttctttatccagcctatcgttgatggatatttggtttgattccatgtttttgctattgtaaatagtgctgcagtgaacatacacatgcatgtatctttataaaagaatgatttatattcctttgagtgtatacccagtaatgggattgctgggtcaaatggtatttctggttctagatctttcaggaattggcacactctcttccacaatggttgaaccaatttacattcccaacagtgtaaaagcattcatgtttctccacagctttaccagcatctgttgtttctggactttttaataatcaccattctgactggcatgagatggtatctcattgtggttttgatttgcatttctctgatgatcactggtgttgagctttttttcatatgtttgttggccgcataaatgtcttcttttgagaaaaaaaaaaa

SEQ ID NO: 28319 - DNA, 2445 bp, Homo sapiens
acagatgatgaaaccaaggttcagagagggtcagaattcagaccaagtcagaattcaaaatctaaactggctccggggtaagtgatactaattgctgtataatactaccacctagaggaacttccaaacatggattcctcaacaaggccaaaaagaccgcattggcttacatcagtggcccacaatggtgtgattttgccttccaggggacctttgcagtgcctggagacattttcagttgttacaatcaggggtgctactggattctgatgggaagaggcctgggatgctgctaaacatcctacaatccccagttcagccccccaaacaaagaattatccagcccaaatatcaccagtggttgagaaattctgccttagatgggatggagctggggggtgggaatagagggaggagaggtcactggggagtggtgggggtgtaggcagtagggaaatgagtgaggctgccctgaggaaaagaactcctgggggcaagcaaactgaaagcaaacttccctgactctctagaattgccttgtgtctggcaaagtggggagacactatgctctctaaggcacacgggtgtaaaaccgctctttccctagggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccagggaaacaataacaacttccaatccaaagccaactgcctgaacacctgcaagaataaacgctttccctgattggataaggatgcactggaagaactgccagaatgtggctcatgctctgagtactgttcctgtacctgacggatgctccagactggcttccagtttcactctcagcattccaagatcttagcccttcccagaacagaacgcttgcatctacctcctcttcctccatctttggctcttttgatgcacaatatccatccgttttgatttcatctttatgtcccctttatctccaacttctagaactcccagtttatacctgtgtcactctcaattttttccagtaaagtacttgatgtagtcctgtgccttgaggctgagtgattgacatctttttggcacattacactttgcagagtaagggatcattgaggcttctggtgacatcattcaagggagtgaagacaatcagaactttgagagttcagagttccaggaatattgttattgttatcttcctctgtttctacaaaagattgtaaaaccctttttaggcaagggcccaaggacagtgccttagtttggatcctctagaaactaaccctgggaaaagggcatgggtgcaggtagtttgtttgagagatttcccaggacatacaagatggggagtgagatgagtaattcagggaagagaagggaagagagaagagtctattatgagctggttactactgtggctcaatcctattggggaccttttaaagaatcatgtaaaacaggcttacaaattttctttttaaaaatattttattttattttacgttccgggatacatgtgcaggacctgcaggtttgttacataggtaagcctgtgccatggtggtttgctgcacctatcaacccattacctgggtattaagccccgcatgcattagctatttatcctgatgctttccctccccctgccccctcaacagtccacgtgttctcattgttcatctcccacttgcaagtgagaacatgtggtatttacttttgttcctgcgttactttgctgaggataacggcttccagcttcatccatgtccctgcaaaggacgtgatctcatttctttttatggctgcatagtattccatggcatatatgtaccacattttctttatccagcctatcgttgatggatatttggtttgattccatgtttttgctattgtaaatagtgctgcagtgaacatacacatgcatgtatctttataaaagaatgatttatattcctttgagtgtatacccagtaatgggattgctgggtcaaatggtatttctggttctagatctttcaggaattggcacactctcttccacaatggttgaaccaatttacattcccaacagtgtaaaagcattcatgtttctccacagctttaccagcatctgttgtttctggactttttaataatcaccattctgactggcatgagatggtatctcattgtggttttgatttgcatttctctgatgatcactggtgttgagctttttttcatatgtttgttggccgcataaatgtcttcttttgagaaaaaaaaaaa

SEQ ID NO: 28320 - DNA, 4989 bp, Homo sapiens
  misc_feature 13, 15, 23, 107, 157: n = A,T,C or G
acagaggtcattnantctttggnaattattatttataaagcactggactatggtttgaaggagaatgaagaaagggaattaagccctcccctagagcagcttatcgntcacatggccaacacggtggaagctgacggtagcaatgatgagggctatnaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccaccccccctccacacttcacgtcagctacatagtttccacagggtaattcactaagagcttgtggagcttggttttaaaatccttagcctggtctgactttaggcatagcttccagttcttccttccttgtcctggtttcttgttcagcttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagttattgctgtttgctaaagcaaaatagcagaaaattttgtatatgaaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcag

SEQ ID NO: 28321 - DNA, 1294 bp, Homo sapiens
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaacaaaaaaaaaaaaaaaaaaaaaaaaaaaaa

SEQ ID NO: 28322 - DNA, 1344 bp, Homo sapiens
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcaatggagtttcagtttcctggaggccatctgtggagtttccagggaacctgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaacaaaaaaaaaaaaaaaaaaaaaaaaaaaaa

SEQ ID NO: 28323 - DNA, 1271 bp, Homo sapiens
aaaatcagggccgggcgcagtggctaacgcctgtaatcccagcacttgggaggcccaggcgggtggatcaaaggtcaggagttcgagaccagcctggccaatatgcaatatggtgacaccccgtctctactaaaaatacaaaaattaggtgggtctggtggcacgtgcctgtagtcccagctgtcctggaggctgaggcagaagaatcacttgaacccgggagttaaaggttgcagtgagccgagatcatgccactgcactccagcctgggcgacagagtgagactctttctcaaaaataaaaaaaaaaaagaagatatgaaaatcagatacataccatctttttagttcctaaggctctcacaagattattttgaataaacaccacccattcaaactggtttttccctttcctgtattatatgaaggggaaaatcctcatgggatggatagtttccagaatttgcccatttccaagccagtacagtaaatgacactggggccgctgagtggaccactgtagaaagcaatggttcttgtttcttattttttacattattttcagggatgtgtgtcccatcaaagtctcattatggaggagttgaattttcccgggacacctatggcagggctgccagacaccagcctaaactgctctcactctcatttccagaccaagggcctctggtggcctgtagggagccatgggcaatcacagcaaccctctctgaggccaaggaagttcaggtatgagctgtacctgaggctgccctggcctctcctctcccgtcagtcctcactgggtgtcttctcaccctgccctctgccagctccactgctttccctgctgggtttcattgcttgtgcaaggaagatacggaagccacacaatgggttggttctttctagcccttcccagactgactataggccagcggggtctgtatctagaaatcttttattactctaagttgaacagtttaatgattagtcattttaatttagagttgagattccattagtatttgactgtggccttcttattgagaactctgttcaactttgaaatgccaaagcaggagcctttgttctttgatcctgccgtgagttaagaaattctgtatttcttcagaagtgtttcattttgtgtaatgaagtcaagggttagagtgactcagtgttccatgagttaagtgtctttgtagaatgaacagtaaacttatctcctaataaaaaaaaaaaaaaaaaaaaaaaaaaaaaaaaaaaaaaaaa

SEQ ID NO: 28324 - DNA, 3244 bp, Homo sapiens
cggcgaaagtccagtatgtgggtccagggtcactcttctagagcttccgcaacggaaagtgtgagtttttcaggaattgttcagatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttgtttggtttggttaatacacagaaatatctagaaatgttctgggactagttgagttgtatctttagtattcaggttgtgaaaaataaagatgtttggctatgcaaaaaaaaaaaaaaaaaaaaaagg

SEQ ID NO: 28325 - DNA, 3616 bp, Homo sapiens
ggaaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcaggtttttcaggaattgttcagatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaatttaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaacggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatgcatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgctcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttgtttggtttggttaatacacagaaatatctagaaatgttctgggactagttgagttgtatctttagtattcaggttgtgaaaaataaagatgtttggctatgcgcttaaaaaaaaaa

SEQ ID NO: 28326 - DNA, 4728 bp, Homo sapiens
gcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgaggata

SEQ ID NO: 28327 - DNA, 1452 bp, Homo sapiens
aacagaagaatcagaagcttttcaaaattccgtcttcaagaagaaacacccgtggaggaagaagacattatacaaaacaaatttagaaactgtatgtatagcttcatgtttttcataaaataggaatgaggacaaatgttgctcttcatcctaccagctgtttgttctttggtaggggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaaaaaaaaaaaaaaaaa

SEQ ID NO: 28328 - DNA, 1368 bp, Homo sapiens
aacagaagaatcagaagcttttcaaaattccgtcttcaagaagaaacacccgtggaggaagaagacattatacaaaacaaatttagaaactgggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggccagacttcgtatgcctaaagagcaactggaacttttaaagaaggaaagccagaatctggaaaacaattttcgtcaaattctatttttgatcgaacaaatagatgtcctgaaggcattgctaagagatatgaaggatggtatggacaataatcacaactggaacacccatggagaccctgtggaggacccggaccacacagaggaagtgtcaaacttggtcaattatgtacttaaaaagttgagagaagaccaagtcgagatggctgattatgccctgaagtcggccggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgccacatgtccagaatattcaagaatgcttattctcttagatgataccgcacccataggaattgagaattgggagtgggaagaaaacctcaaagtggttcatacttgcctgtaaaaagtaaatgcattttactaataaaaaaatatggaagtaaattaaaaaaaaaaaaaaaaaa

SEQ ID NO: 28329 - DNA, 3093 bp, Homo sapiens
cggggccgaggcgcgaggaggtgaggctggagcgcggccccctcgccttccctgttcccaggcaagctcccaaggcccgggcggcggggccgtcccgcgggccagccagatggcgacgtggcggttccccgcccgccgcgaccccaactccgggacgcacgctgcggacgcctatcctcccccaggccgctgacccgcctccctgcccggccggctcccgccgcggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctccaaaaaaaaaaaaaaaaaa

SEQ ID NO: 28330 - DNA, 3503 bp, Homo sapiens
ttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaaatattttggatgcaaaaaaaaaaaaaaa

SEQ ID NO: 28331 - DNA, 2672 bp, Homo sapiens
aggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccctgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcgcatgatcgggatatgcgaggccgagtcctggatgctagttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattatgccaagatcagtgatttcggactctccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaaaaaaaaaaaaaaaaa

SEQ ID NO: 28332 - DNA, 4862 bp, Homo sapiens
actgcgcggctccccgcgccgcagctgggcaccagcagcaccacggaccgcccctgtgctcgcccgacggcgccccgcggcgctttaagagacggcctggcagcccagccccagccgcccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagagccagcagctgggccgagtggtggtgggcccctacatgtacacccgcggcagagagctggagcactgggacgagatgctcagcaagcccaaggagctggtgaagcgctggcatgcgctctgccgcaccacggagccctgacccttcgcccagcaccgcggttccgctttgggagccgaccatcctcgcagttgcatgtgacagccacagccacacgcatggacgtttcatccaacagctccccgagctgccagccagcccgagccaggaggacgtgagtgctgatatgcaggagagaagaggggacaaagaagccctggcccggtcagcggctctggccatacagccttccgacacactccctcctccttatctgcggggctgcctgggctcggaatcccggctcctggtcctcacagccctgatttggaccagaatctcagatgctcagaagaaagatcctgtttagtgatgacccagctctacctgctgaatggacctgcagggtaaacttgggtgcctccatctgggaaagctgatgatgtgttcatgcagtcgatgaccctcactgctttttcagccagggtttctctgccttctgcctggcagagaaaacacactgctatggggaaaatcacagggagggcgctgtgaccagcgcactcaggcaccaagtgtcggcatggctcactgtgctgggtgaaggcctccccgagcattaggtcctccacggggctgtgtcaaatgccctcccacattgtgtcaagtctgcccatggcccaccctccccacagtccaaaaccacacagccctggttctccagctgttctgctgctgtttctgtgctctccctgattaagagcattcagttcctgggctctccctttgagcaggaaatggtgaaagcatgtggctatggtatagcccacagggctgagattgctgtgttgcagtattgatgtaaaatttgttaagaaggaagtacccacagatcactgccatcaactccccagaagttgcactcaagctagtgagcagcccttgtgcttgtcacagttactgtaacaggtagtgtgtatttgcacctggcatcgtgcagcctgcacgtcaacacgttgttttgtgtaactagaacagcacatggaaccactatctctttctcttttttccttctttttcttttttttttttttattttaattttttgagacggagtttccctcttgtcacccaggctggagtgcaatggcgtgatctcggctcactgcaccctccacctcccaggttcaagcgattctcctgcctcagcctcccaagtagctgggattactggcgcccgccaccatgcctggctaattttttttatttttagtagagacggaattttaccatgttggctaggctggtctcaaattcctggcctcaggtgatccacctgcctcagcctcccaaagtgctgggattacaggcatgagtcaccgcacccagcccgaccagtatctttttcttatgcagtgaaacaactttagcaaaagaggcaatgaatgttatactgagtttctacctctttaactccacctccaatttctgtcaatctacaaacacaagtgtcgcctcgcagtgtttcgtatgaacagaatatcttgtgtttgctttttgtcacttatttcacttgcacattttttgtttgtttgtttgtttgtttgtttgttttttgagatggagtcttgctctgtcgcccaggctggagtgcggtggcgcgatctaggcttactgcaagctccgcctcccgggtttacttacaccactgtcctgcctcagcctccggagtagctgggactacagacacctgccaccacgccctgctaattttttgtattttcaagtagagacggggtttcactgtgttagccaggatggtctcgatctcctgacctcatgatctacccgcctcggcctcccaaagtgctgggattacaggcgtgagccaccacgcccggcccacttgcacattttcaaagtagtccgcaaagctgtagtttctaatagcttcatagctcacatgtaataggggttctctgtgtgtttatagagcaggctactacagtggaactgtttctgtttcatctgacatccggatagatgccagccacccccacattccaaggtgagatttctgactagcagtgacttttctagggccgcttggaaaagttgataagtatccttttctgcaggacagagtagactggtatctctgactcatccctgaaaaatctaaatggcaagagactagctggctctctgctctgatggggaggaggttgttgtttgggctgttctctacagacatagtcagggcaaaaagcatacgcatgcttcccatggaccagagaaacctggcctgggttgtctcaaatcctgtccacaaggcaactccagaagaaagaagccctttacatttccataaaacactttagaatcagctagtcaatttccacaaaataaagtgctagaatttgattggatttaattgattatgtagaacaatttgggggccatttgacatcattaaaatattcaatcttcctattcattaacatggtatatctcttcactttaagtcttttgtatgtttctcagaactatttttgtggttttcagtaaagtgttcttgcacatccttcaatagatttattcttagacgttttatatttgtttatggctagtatatacagattctgttgctacaaaactatgttgaccttgttatccagtgagaggctttgtgacattcatttaaattgtaataatttgcagattatttttgtataatcatgtcctctgtgaatgacagttttatttcttcctttcttaatctttatgccttatttagctcttgccaaactgcagtggctgagcaattggacaagataaagaaataaaagtgatccagatcataaagaaagaagtaaaactatatctgcacatgacataatcttgtctatggaaaatcctaaggaatccacacacaaaaaaactactagagctaataagtttggcaaggttgcaagatataaaattggtatacaaattgcagtggctaggacctccagcagaatgctgactataagtagtgatagtgggtattcttgtctcatcctcaatctcaggggtggtgggtgtggcatgtggagagttgtcaatattcaccatgaagtttgatggttgttataggatttttaatgtactcattaacatatattctcaagctgttaaaaagatttttttaattacaaataaggttaaatttctctcaaatacttactctgcaccttttgaaataattttatttttctcctttattctttggatgtgatgacttatactaattgactgttgaatgtcaaaccaaacttaacattcttgtaatagaaaccagcagggtgtgtacacttttgtgtgtgtgcgcaggtttatacacataaacacaacaatacttggacttatttatttaaaatttagatttattagagggagcatggccataaaataaaataaaataaaatttagatttaagtcga

SEQ ID NO: 28333 - DNA, 1256 bp, Homo sapiens
caacccatctccgaaaaggattaagcatcactagggctccaagtgagttctgatcagaggctgttcggaagacagcaggggccatgaccaccctctctcctgaaaacagcctctctgccagacagtcagcctccttcatcctggtgaagagaaaaccacccattgacaagacagaatgggacagcttctttgatgagagtggccacttggccaaatcacgggacttcatttgtgttaacatcctggaaaggggtctgcaccccttcgtgaggactgaagcctggaaattcctcacgggctacttctcatggcagagttcccaggatgagcggctcacggtggacagcatgaggaggaagaactacaaggccttatgccaaatgtatgagaagattcagccccttctggaaaacctgcaccggaacttcacagagactcgcaataacattgcacgtgacattcagaaaatctatgacaaagatcccctgggcaacgtcctcatcgacaagaagaggctagagaagatcttgctcctgagttacgtctgcaacacgcaggcagagtaccagcagggcttccatgagatgatgatgctcttccagctgatggtggagcacgaccacgagaccttctggcttttccagttcttcctgcagaaaacggaacacagctgtgtcatcaacattggcgtggccaagaacctagacatgctcagcaccctgatcaccttcctggaccccgtgtttgctgagcacctaaaagggaagggtgcaggggctgtgcagtccctcttcccctggttctgcttctgcttccagcgtgccttcaagtccttcgatgatgtctggaggctctgggaggttctgctgacggggaagccctgcaggaacttccaggtgctggtggcctacagcatgctgcagatggtgcgggagcaggtgctgcaggaaagcatgggcggggatgacatcctcctggcctgcaacaacctcatcgaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagtcctctggaataaaaaaaaaaaaaaaaaaaaaaaaaaaaaaaaaaaaaaaaaaaaaaaaaaa

SEQ ID NO: 28334 - DNA, 1867 bp, Homo sapiens
ggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 28335 - DNA, 957 bp, Homo sapiens
ggatatgaggcaggagggcttggggacaactgtggggacatggcccagatgatctgatcctggcagtagtgactgttggggaccaggatgctggcaggtcaactcgaggccagggaccccaaggagggcacccacccagaggacccgtgcccaggagctggggctgtcatggagaagacagctgtggcagccgaggttctcacggaggactgcaacactggggagatgccaccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattcaaaatagacctagtaatttattaaactaattatgtttctatagataaaaacttgaagttcttcagacatgtctctaatgctataaaagcaaacaacttggattgggtttta

SEQ ID NO: 28336 - DNA, 1977 bp, Homo sapiens
gcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaagaaaaaaaaaaaaaa

SEQ ID NO: 28337 - DNA, 2147 bp, Homo sapiens
gtgcgcagcggccatggcttcctcaattatctgccaggagcactgccagatctcgggccaggcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaacctaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctggctaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggtactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctgaaaaaaaaaaaaaaaaaaaaaaaaaaaaaaaaaaaaaaaa

SEQ ID NO: 28338 - DNA, 4825 bp, Homo sapiens
atcagtccgcattccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataacagaaaaaaaaaaaaaaaaaaa

SEQ ID NO: 28339 - DNA, 4945 bp, Homo sapiens
atcagtccgcattccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtcatcagtccatgcaatcaacttgttcaccagagtcttctgaggatataacagatgaatttttaactccagacggtgaatatttttactcctcgactgctcaagaaaacttagctctagagacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataacagaaaaaaaaaaaaaaaaaaa

SEQ ID NO: 28340 - DNA, 1337 bp, Homo sapiens
gggagagtgaggccgcgggggctgggaagggaccggtgtatgggggacagcaggcgaaggtcactcgggaaccagcccagctctgaggctgcgggcaggtcggaaagggagcaggacggcgacccccgtggcctccagagctctgtgtacgagagccggcgggtcacagaccccgaacgccaggacctggacaatgcagagctgggaccagaagacccagaagaggagcttccccccgaggaggtggccggggaggagttcccggagaccctggatcccaaagaggcactttctgagttggagagagtcctggacaaggacttggaagaggacattcctgaaatcagccggctgtccatcagccagaagctccccagcaccaccatgaccaaagcaaggaagaggaggaggcggaggaggctcatggagctggcagagcccaagataaactggcaagtcctgaaagacaggaagggacgctgtggtaaggggtatgcctggatctccccatgtaagatgagcttgcacttctgtctctgctggccctctgtgtactggaccgagcggttccttgaggacaccaccctcaccatcacagtgcccgcggtgtcccgccgcgtggaggaactgtctcggcccaagagattctacctggaatattacaacaacaacaggacgactcctgtctggcccattcctcggtcctccctggaatacagagcgtcgagtcgcctgaaggaactggccgccccgaagattcgtgataacttctggagcatgcccatgtctgaggtgtcccaggtatccagggcagcccaaatggcagtccccagctcgcggatcctccagttgtcaaagccgaaggccccagccaccctcttggaagagtgggaccccgtgccaaaacccaagccacatgtgtcagaccataaccgcctccttcacttggccaggcccaaagctcagtcggacaagtgcgttcctgaccgagatcctcgctgggaggtgctggatgtcaccaagaaggtggtggccagcccccggatcatctccctggccaagcccaaagtgcgcaagggcctcaacgagggatacgacaggcgtcccctcgcctctatgagcttgccacccccaaaagcatcaccagaaaagtgtgatcaacccaggcctggcctctaagacctccgctcccagtaaacaccctcaggcaccctaaccctgtgtatgtgattattctgagctttttggcctggagaagggagggcgggctagaaggccaaaagaaggatgaggaggacaataatatttatttttgcatccaaaaaaaaaaaaaaaaa

SEQ ID NO: 28341 - DNA, 1265 bp, Homo sapiens
gggagagtgaggccgcgggggctgggaagggaccggtgtatgggggacagcaggcgaaggtcactcgggaaccagcccagctctgaggctgcgggcaggtcggaaagggagcaggacggcgacccccgtggcctccagagctctgtgtacgagagccggcgggtcacagaccccgaacgccaggacctggacaatgcagagctgggaccagaagacccagaagaggagcttccccccgaggaggtggccggggaggagttcccggagaccctggatcccaaagaggcactttctgagttggagagagtcctggacaaggacttggaagaggacattcctgaaatcagccggctgtccatcagccagaagctccccagcaccaccatgaccaaagcaaggaagaggaggaggcggaggaggctcatggagctggcagagcccaagataaactggcaagtcctgaaagacaggccctctgtgtactggaccgagcggttccttgaggacaccaccctcaccatcacagtgcccgcggtgtcccgccgcgtggaggaactgtctcggcccaagagattctacctggaatattacaacaacaacaggacgactcctgtctggcccattcctcggtcctccctggaatacagagcgtcgagtcgcctgaaggaactggccgccccgaagattcgtgataacttctggagcatgcccatgtctgaggtgtcccaggtatccagggcagcccaaatggcagtccccagctcgcggatcctccagttgtcaaagccgaaggccccagccaccctcttggaagagtgggaccccgtgccaaaacccaagccacatgtgtcagaccataaccgcctccttcacttggccaggcccaaagctcagtcggacaagtgcgttcctgaccgagatcctcgctgggaggtgctggatgtcaccaagaaggtggtggccagcccccggatcatctccctggccaagcccaaagtgcgcaagggcctcaacgagggatacgacaggcgtcccctcgcctctatgagcttgccacccccaaaagcatcaccagaaaagtgtgatcaacccaggcctggcctctaagacctccgctcccagtaaacaccctcaggcaccctaaccctgtgtatgtgattattctgagctttttggcctggagaagggagggcgggctagaaggccaaaagaaggatgaggaggacaataatatttatttttgcatccaaaaaaaaaaaaaaaaa

SEQ ID NO: 28342 - DNA, 1577 bp, Homo sapiens
gcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtctggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaaaaaaaaaaaaaaaa

SEQ ID NO: 28343 - DNA, 1306 bp, Homo sapiens
ataagaggttgggctttggatagatagacagactcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgctgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttaaaaaaaaaaaaaaa

SEQ ID NO: 28344 - DNA, 2773 bp, Homo sapiens
aggcggaggggaggcgagggcggggcggtcacgtgagagcactgccgcggtgggttgtgggggtgctgcggcgccgtttgctttgccaaaccgacaaaagagagatgatggccaacgacgccaagcccgacgtgaagaccgtgcaggtgctgcgggacacagccaaccgcctgcggatccattccatcagggccacgtgtgcctctggttctggccagctcacgtcgtgctgcagtgcagcggaggtcgtgtctgtcctcttcttccacacgatgaagtataaacagacagacccagaacacccggacaacgaccggttcatcctctccaggggacatgctgctcctatcctctatgctgcttgggtggaggtgggtgacatcagtgaatctgacttgctgaacctgaggaaacttcacagcgacttggagagacaccctaccccccgattgccgtttgttgacgtggcaacagggtccctaggtcagggattaggtactgcatgtggaatggcttatactggcaagtaccttgacaaggccagctaccgggtgttctgccttatgggagatggcgaatcctcagaaggctctgtgtgggaggcttttgcttttgcctcccactacaacttggacaatctcgtggcggtcttcgacgtgaaccgcttgggacaaagtggccctgcaccccttgagcatggcgcagacatctaccagaattgctgtgaagcctttggatggaatacttacttagtggatggccatgatgtggaggccttgtgccaagcattttggcaagcaagtcaagtgaagaacaagcctactgctatagttgccaagaccttcaaaggtcggggtattccaaatattgaggatgcagaaaattggcatggaaagccagtgccaaaagaaagagcagatgcaattgtcaaattaattgagagtcagatacagaccaatgagaatctcataccaaaatcgcctgtggaagactcacctcaaataagcgtcacagatataaaaatgacctccccacatgcttacaaagttggtgacaagatagctactcagaaaacatatggtttggctctggctaaactgggccgtgcaaatgaaagagttattgttctgagtggtgacacgatgaactccaccttttctgagatattcaggaaagaacaccctgagcgtttcatagagtgtattattgctgaacaaaacatggtaagtgtggcactaggctgtgctacacgtggtcgaaccattgcttttgctggtgcttttgctgccttttttactagagcattcgatcagctccgaatgggagccatttctcaagccaatatcaaccttattggttcccactgtggggtatccactggagaagatggagtctcccagatggccctggaggatctagccatgttccgaagcattcccaattgtactgttttctatccaagtgatgccatctcgacagagcatgctatttatctagccgccaataccaagggaatgtgcttcattcgaaccagccaaccagaaactgcagttatttataccccacaagaaaattttgagattggccaggccaaggtggtccgccacggtgtcaatgataaagtcacagtaattggagctggagttactctccatgaagccttagaagctgctgaccatctttctcaacaaggtatttctgtccgtgtcatcgacccatttaccattaaacccctggatgccgccaccatcatctccagtgcaaaagccacaggcggccgagttatcacagtggaggatcactacagggaaggtggcattggagaagctgtttgtgcagctgtctccagggagcctgatatccttgttcatcaactggcagtgtcaggagtgcctcaacgtgggaaaactagtgaattgctggatatgtttggaatcagtaccagacacattatagcagccgtaacacttactttaatgaagtaaactaggcttatttctaaaaagtcaagtctattggctttggcccaaaagcactggtatctttgtattaaattcatgtttattgtcacaaaaccattatttatacctatacagttgtactgtttcttttaaagcaaagccatttaacatctttcttcattcctaatttggaaattaaagtttacctttctgttaatctatgtataaatgttactctgagttattaatgtggattttaaaattgtaagcaatagaataggaaataaaacaactacctaatacaaatatttctgataagactacaaatatcttactgagctggggattaaagtagaggtaactgtatcttaaatgagtatgatttccttgtaagttaaaaaaattgaaatttaattgtagacttcaatagtccaagttttgaaggatgtttgagcttttgtataatgccatttatacctgcagttttacagataatgtttgactgcagttgccttggaaattcctccaaagtttgccttcatctctcctctacagtttggaggtgatggtgcagcagtggaacatctcttgatgcaccacactacttgtgttgtgtgaagtgatgaaagtataactggttctagtttgcacactacacacatagttttgtgaagcttcagaaatgttttttcttttccttgtggccaaaccagtttgttaatctgattatattcatctgctaatgatactaaagttaatgtaataaagcatttaaaaatcaaaaaaaaaaaaaaagaaaaaaaaaaaaaaaa

SEQ ID NO: 28345 - DNA, 1186 bp, Homo sapiens
gggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaaccagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaagattttttgctgtctctttttcatcaccctatttttcatcagactgctgagctacatgttttttcatgtaagattcataaatccagatctcctcgtcaatgtactgcccaaggtactgggcaggagcaccttgtggaagctcagatgcttcttctttccatctctcacacttgagacagaggacatgttaccccactgattccctaagaaatatccttgagcaatagaagggaagtgggatccgagcctgtagaagggaggcatgaaacttgtggaggaaagagatttgcttcagttttttcctcaccgtttgcctgcttgactaccttctgtcaccacgtcatctttccaggattaaccttgaccagtaaaaagctctgtaatagaaaaaaaaaaaaaaaaaaaaaaaaaaaaa

SEQ ID NO: 28346 - DNA, 732 bp, Homo sapiens
aggcagttgcgggttgcaggagttcaggaaaggaggtgggactagagtcaacctggaatagctctacagtaacaatggcagcctttttgttgctgggacatccatacaggcaacttagctggtgaaaggactctggattggttggcagtctgcttttttttttccaaggtgatcactttactgtagaagaaatgaggttaacagaaaagagtgagggagaacaacaactcaagcccaacaactctaatgcacccaatgaagatcaagaagaagaaatccaacagtcagaacagcatactccagcaaggcagcgaacacaaagagcagacacacagccatccagatgtcgattgccttcacgtaggacacctacaacatccagcgacagaacgatcaaccttcttgaagtccttccgtggcctactgagtggattttcaacccctatcgattgcctgctctttttgagctttatcctgaatttcttctggtgtttaaagaagccttccatgacatatcccattgtctgaaagcccagatggaaaagatcggactgcccatcatactccacctcttcgcactctccaccctctacttctacaagtttttccttcctacaattctttccctttctttctttattcttcttgtacttctgcttctgctttttattattgtcttcattctgatcttcttctgattcttttgtttcaataaacagcaatgagcatgaa

SEQ ID NO: 28347 - DNA, 2932 bp, Homo sapiens
agccctcccttgcacgttccggctcctcctctatcttcacgcccacgctaggccctgagcccacctctacgtctcgccgccaactccacatcctggctcctatctctgccttccaggcatctcccagctgcacgctcgggcccggctcagagccctaagccctgcctcccggtcctggccgggtttcccagaactgcacggcgcctctccgcccaggcccaagcgcgagcccctcctccacacccgagtcccagccccgcgtcccggattcggacccgcctgcctggggcggtgctgcaccaggtgcgggtgtggcaggcgtctcggagcgccaggtgcagcttcctgatcaagatggtcgccgcctgccgctcggtagccgggctcctgccacgccgccgccgctgctttcccgcccgggccccgctgctgcgcgtcgccctctgcctcctgtgctggaccccggcggctgtgcgcgcggtccctgagctcgggctctggttagagacagtcaacgacaaatcaggacctttgatatttaggaaaactatgtttaactctacagatatcaagttatctgttaagtcattccattgttctgggcctgtgaagtttaccatagtgtggcatttgaagtatcatacctgtcacaatgagcattctaatctggaagagctgttccaaaaacataaacttagtgttgatgaagacttttgtcattatttgaagaatgacaactgttggacaacaaaaaatgaaaacttagattgcaacagtgattcacaggtgtttccctctttgaataataaagaactaataaatatcagaaatgtttcaaaccaggaaagatcaatggatgttgtagccagaacacaaaaagatgggtttcatatctttattgtttctattaaaacggagaatacagatgcaagctggaatttgaatgtttctctttctatgattgggcctcatggatatatctctgcatcagattggcccctaatgattttttacatggtgatgtgtattgtttatatattatatggcatactctggctgacgtggtctgcctgttattggaaagatatattaagaatccagttctggattgcagctgttatttttttgggaatgcttgaaaaagcagttttttatagtgaataccaaaacatcagcaacactggactgtcaacccaaggcttattgatatttgcggagttgatttctgcgattaagaggacgttggctcgccttctcgtgatcattgtgagcctgggctatggcattgtgaagcctcgtttaggaacagtcatgcaccgggtgatcggactggggcttctatacttaatctttgcagctgttgaaggcgtgatgagagtcattgggggttctaaccatttagctgttgttcttgatgacattattttagcagttattgactccatttttgtgtggttcatttttattagtttggcacaaactatgaagaccctaaggctaagaaagaacactgtgaaattttcattatatagacattttaaaaatactctgatctttgctgtgctggcttctatagtgtttatggggtggacaactaagacatttagaattgcaaaatgccaatcagattggatggaacgctgggttgacgatgcattttggagcttccttttttcgcttatccttattgtaatcatgtttttgtggagaccatcagcaaacaatcagagatatgccttcatgcccttaatagatgattctgatgatgaaattgaggaattcatggtaacttctgaaaatttaaccgaaggaataaaattaagagcctcaaaatcagtttccaatggaacagctaagcctgccacttctgagaactttgatgaagatttgaagtgggtagaagaaaatattccctcttcattcacagatgtagctcttccagtgttagtggattcagatgaggaaatcatgaccagatctgaaatggctgaaaaaatgttctcttcagaaaagataatgtgattggaacccgtataagaaatgtagttaagcctgaaggactatccttcatcaagactgaaagtgagctttgatttgatattgcctaaaaatttttattgtgttatcttggaagtctgtgtatcaaaatgaagaattcagatggtaggaggttctatagtccttttaaagctgactcttgagtgtcagttgaatatccattaagttggatttggaaataacctgaggaaagtattatgataaagatctgcacagatgcctcttagctgataggtggcaggcctgtgggttcgggttctccctcttttctctggaacatatgacaattccagattaaagaaaaatgttttttaataaatacccttggtctttcttctagtcacctttgaggtagatattgtgattttctggagtatagtatatccgtgtctctgtgtcttaggtttactagatgcaataatacttctctttgacatttgtactgaagtgatttgatattaagtaaaacagttaatgtttgaatataggcatatttataggttttttccgctcccccccaacccaccctttttaaaaaatctatacaaagcccttgtttgagtctcatcatgcacatcaaatcatggagttaggtcttctctgagctcaggggaacacaagtgcacagagagagatgtcttgagggtcactaccaaagaattaccctcattgtccctcactcaggccatgtgtacatgcgatgctgctgagtgtgctggggtgggtggtggccacgtggctcccccagagcacttcctaactggcaagctgggagacccattactggtgaactttgtggaaattagaactgtatcttttacataatcttggcatattacatttcataataaaaacatacatttagttgcatgct

SEQ ID NO: 28348 - DNA, 1169 bp, Homo sapiens
gcgccgccccatcccccagtggtcctcatgtggaggctggcactaggcggggttttcctggcagccgcccaggcttgtgtcttctgtcgcctcccagcccacgacttgtcaggccgcctggctcggctctgcagccagatggaggccaggcagaaggaatgtggggcctccccagacttctcggcctttgccttagatgaggtgtccatgaacaaagtcacagagaagactcacagagtcctgagggtcatggaaatcaaagaggctgtctcctcactcccttcatattggagttggcttcgaaagaccaagctccctgagtacaccagggaagctctctgtccccccgcctgcccgttgcctctgctgtctcctgcagggggcagcaccacgctgtacaactgctccacctgcaaggggacggaggtgtcctgctggccccgaaagcgctgcttcccaggaagtcaggatctttgggaagccaagattctgctcctctccatcttcggagctttcctgcttctgggtgttctgagcctcctggtggagtcccaccacctccaagcaaaaagtggcttgtgaagacgctgaaaacctcccagcctccagctctaaggggtatgcactcacaacttccacatcccttggaggggaaccagtcagccccttagtcccagctccaaagacagtctccagaccctaaaacccagacatccctgcttctggttggtgagataatgaaaaacaagaaaatccccaaaaacccagatcccccacaatcccagtgtcagatggcctcccgggaacccaggcacccacagctggaaagttcctcccctccagccctcaaccaatcacatggctgtcaacaatgccaggaaaatatctacagaaggaaagaatcccctacgccactcccaccacacccacacccccttctgcctgttccgggaaagcgggggcatctgccccagaagctattccaggccctcctatgactgatggggaatccgggaatgcatgttctggaaaactcaccccactagagtgagatcacatcagtgggttcgcgggcatgccctccctccatcgtgttaacagtttgaaatcctggcctccctcagaggcctccatcctgccaggcctaagtaaaacttgctgttcatggc

SEQ ID NO: 28349 - DNA, 870 bp, Homo sapiens
gcgtccgccgcctccggaactaaacggggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggacatcggttgagagaaggacgacttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatacttaaaaaaaaaaaaaaaa

SEQ ID NO: 28350 - DNA, 1475 bp, Homo sapiens
acctgccgccatcttgctcaccagcctccaaaatgcggctggggctcctgagcgtggcgctgttgtttgtggggagctctcacttatactcagaccactactcgccctctggaaggcacaggctcggcccctcgccggaaccggcggctagttcccagcaggctgaggccgtccgcaagaggctccggcggcggagggagggaggggcgcatgcaaaggattgtggaacagcaccgcttaaggatgtgttgcaagggtctcggattatagggggcaccgaagcacaagctggcgcatggccgtgggtggtgagcctgcagattaaatatggccgtgttcttgttcatgtatgtgggggaaccctagtgagagagaggtgggtcctcacagctgcccactgcactaaagacgctagcgatcctttaatgtggacagctgtgattggaactaataatatacatggacgctatcctcataccaagaagataaaaattaaagcaatcattattcatccaaacttcattttggaatcttatgtaaatgatattgcactttttcacttaaaaaaagcagtgaggtataatgactatattcagcctatttgcctaccttttgatgttttccaaatcctggacggaaacacaaagtgttttataagtggctggggaagaacaaaagaagaaggtaacgctacaaatattttacaagatgcagaagtgcattatatttctcgagagatgtgtaattctgagaggagttatgggggaataattcctaacacttcattttgtgcaggtgatgaagatggagcttttgatacttgcaggggtgacagtgggggaccattaatgtgctacttaccagaatataaaagattttttgtaatgggaattaccagttacggacatggctgtggtcgaagaggttttcctggtgtctatattgggccatccttctaccaaaagtggctgacagagcatttcttccatgcaagcactcaaggcatacttactataaatattttacgtggccagatcctcatagctttatgttttgtcatcttactagcaacaacataaagaaattctgaaggctttcatatctttattttgcattgtgtccctttctatgttctatataatgaacatcatttattcttctagcaattaattgcctacattagagatttcatgtgaacattttatgggctataagtattgtgacagatatacaattgtaattttggcactgaatcacatgtctccttgaaatatcttgattattttataatcataattctgtatctggaatactcatagagtttgtacaaaatattcagttaaacatatatgtgtataaatgccaaataatagtttataattaaaatgaaagctgtcatttggttaaattaataaaaattctttcttagattttattctaaaaaaaaaaaaaaaaaaagaaaaaaaaaaaaaaaa

SEQ ID NO: 28351 - DNA, 419 bp, Homo sapiens
aagggcccctcattttggcagaacttaccatgtcgaccagccgcaaattaaagagtcatggcatgaggaggagcaagagccgatctcctcacaagggagtcaagagaggtggcagcaaaagaaaataccgtaagggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaagcagaaaaaaaaaaaaaaaa

SEQ ID NO: 28352 - DNA, 599 bp, Homo sapiens
aggatgaggaggaggccctgcccctccaaacgtggcctcctatggacacccagactcacagccttcctatcacccacactcagctccatagcaactctcagccccaaagccgcacctgcacccgccattgccaaaccttcagccagagttgcagacagagccatcgtggcagccggagccagagctccagccagagcccggccagccaccgcaacccaactggagcccacagctcatccggccaccagagccagagtcccaacactagtccaccaccaaagcgccacaaaaagactatgaactcccaccactctcccatgcggcccaccatcctgcactgccgctgccccaagaacagaaagaacttggaaggcaagctgaaaaagaaaaaaatggccaagaggatccagcaggtgtacaaaaccaagacgcggagctcaggatggaaatccaactaatgagaccgcactccttggcttgttcctgcgtgtttcacccaaaggagaaaatgctaggatgaagtcaatcttcttgcaggaacatgttactatggtgatttctacgcaacactaattaaagcttgtacctggaagactaaa

SEQ ID NO: 28353 - DNA, 2296 bp, Homo sapiens
gggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgcaaaaaaaaaaaaaaaa

SEQ ID NO: 28354 - DNA, 1917 bp, Homo sapiens
aagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccccctgggcagggagagggccaaggacaattgggagggcagcaggcagcccgcagatggtggccatgtggcacgctgctgagacgacactaccaataaaccaaactgccacgcacacactgcaggctcacacccgcaaaaaaaaaaaaaaaa

SEQ ID NO: 28355 - DNA, 1079 bp, Homo sapiens
acaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacactcagatcttttgaaggaaaccctaaaggagaaggaagcagaatataaccctctggagagctcaagacagtaggaacctggacggtgcttgtttgaattttctgatatctgattttcacacgaatatactttttgtttgttttccttttccattttcaaaatgccaagatctgggagcctctttcactcctctagacacactgcctgagatagaagtttgcatcttattggctgtgggcagagactaggacccttatgggtacatttcagtaatctctcactgcctaaaatggtaatccctccagcctaagaggatgattctgttttgttgactcttgaatgctcccccaacattcctttggttttcctataagcaaaaccaaataccactataaatacaaaagcatctggtaaactgtaaagttactcatgtatcccaaccctccacagatttctgaagacaaagttttgcttggattaaaacaagatgttttactattttgcaaa

SEQ ID NO: 28356 - DNA, 2298 bp, Homo sapiens
acaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacactcagatcttttgaaggtctgatggggacaatcaagtccaaagtctcagggggcaaaagagcttggccctgactgtctttcttctgcggagggtggggttgatctgctctcagttttggggtgtggggaagacccactccagattccggggagtgggaatgagccactcccagttctggagagtgaggatgaccatctccactttctggaaccagaatgagcccccttggtaaccttgcctggtactaaaccagtgcaaggacccccttcccttattacatttgcaactctgcccaacaaaaacaagcaagcaaaccacaatggtaaagtggttaattcaggaaattgacagaatccagttttgagaaaagaacacagatatttgctgcttttaagatagagaacccaaagttttgtacctggttatttttcacttaagtttgtagacgaaatgtgccattatattagctttcctgagactgtatctaatgggcaagtcagtggctccagaggggtcttaggccaaagcccaaactctcttttggaaaactagcttattagaaagccaaagtagagttctgtttaagcttgaaagaggtatgaagtaatctgtagtgtttttttggtttgtttgtttgttttcccttccccatttccttccttccctcagtctcaaagtcaccttgaaagcttcacctggcctacaacttttattttaaaaagatgatcaagaaaacttcatcttctctgagactcagaaaaagaggggaaaatagtggtagtgcactaattgttacattactaatatagcttttgtaaaactcgtttgttttcaaaggtctggactaagcaaaacaacagtgtcagtttaggaaattattactactttgaacacaaactgaaattgcaactttgccttgtgctttgtttataatttctttgtatatcaaaatgagtgttttaaagtttaacccttgaagcagcatgtctttgccatagcagcacttcacttaaaaggaagaaattgcctctctggcagcaattcctagttagttaccacctccagctgaggggctggaggaaaacaggtatagccaaattcaagaaagataaacccctgtctcaaggaacattttaaaaagaacgtctgtcccctgtgatgctggctgttatgcctttgaatggacctaactatacatctttgctcttaactccaagtctgcccttctttttaggaaaccctaaaggagaaggaagcagaatataaccctctggagagctcaagacagtaggaacctggacggtgcttgtttgaattttctgatatctgattttcacacgaatatactttttgtttgttttccttttccattttcaaaatgccaagatctgggagcctctttcactcctctagacacactgcctgagatagaagtttgcatcttattggctgtgggcagagactaggacccttatgggtacatttcagtaatctctcactgcctaaaatggtaatccctccagcctaagaggatgattctgttttgttgactcttgaatgctcccccaacattcctttggttttcctataagcaaaaccaaataccactataaatacaaaagcatctggtaaactgtaaagttactcatgtatcccaaccctccacagatttctgaagacaaagttttgcttggattaaaacaagatgttttactattttgcaaa

SEQ ID NO: 28357 - DNA, 2788 bp, Homo sapiens
aaggcagggggcggggcgtctccgagcggcggggccaagggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgtcagtgtctttcttcttttttgaaggtacatacttcacagtttccatcttgtatttacctaaatttggaacacagtatgcaggaacatcaggcatcattttgaagaactttgaaatagaactttcaaagcaaaaacttgagatattcaaaaattgtgattccccaacacccacttacttacatatttttggtcaagtatttattccctgctttggttcacatttgtaatttcagatttattagaaagctaatttatatatttttcttccccttcatttacaaactgtctgttaacagattggcaaccaagactaagttttaaatccagaagagagaaatgtttcacgcaagcagtcccccaactcccaacacacactccctttcattccgagcactaaataggtagcttacttgacaagcttcctttaattacacacagacatgggggttggggtaagaagatggtggtaaatatgaaaagtaatctttaataacttctgcttttgtataaaattgtaagtgaagtcaaaagaaaaaaaaaaaaaaaaaaaaaaaaaaaaaaaaaaaaaaaaaaaaaaaaaaaaaaaaaaaaaaaaaa

SEQ ID NO: 28358 - DNA, 2734 bp, Homo sapiens
aaggcagggggcggggcgtctccgagcggcggggccaagggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgtcagtgtctttcttcttttttgaaggtacatacttcacagtttccatcttgtatttacctaaatttggaacacagtatgcaggaacatcaggcatcattttgaagaactttgaaatagaactttcaaagcaaaaacttgagatattcaaaaattgtgattccccaacacccacttacttacatatttttggtcaagtatttattccctgctttggttcacatttgtaatttcagatttattagaaagctaatttatatatttttcttccccttcatttacaaactgtctgttaacagattggcaaccaagactaagttttaaatccagaagagagaaatgtttcacgcaagcagtcccccaactcccaacacacactccctttcattccgagcactaaataggtagcttacttgacaagcttcctttaattacacacagacatgggggttggggtaagaagatggtggtaaatatgaaaagtaatctttaataacttctgcttttgtataaaattgtaagtgaagtcaaaagaaaaaaaaaaaaaaaaaaaaaaaaaaaaaaaaaaaaaaaaaaaaaaaaaaaaaaaaaaaaaaaaaa

SEQ ID NO: 28359 - DNA, 2674 bp, Homo sapiens
aaggcagggggcggggcgtctccgagcggcggggccaagggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgtcagtgtctttcttcttttttgaaggtacatacttcacagtttccatcttgtatttacctaaatttggaacacagtatgcaggaacatcaggcatcattttgaagaactttgaaatagaactttcaaagcaaaaacttgagatattcaaaaattgtgattccccaacacccacttacttacatatttttggtcaagtatttattccctgctttggttcacatttgtaatttcagatttattagaaagctaatttatatatttttcttccccttcatttacaaactgtctgttaacagattggcaaccaagactaagttttaaatccagaagagagaaatgtttcacgcaagcagtcccccaactcccaacacacactccctttcattccgagcactaaataggtagcttacttgacaagcttcctttaattacacacagacatgggggttggggtaagaagatggtggtaaatatgaaaagtaatctttaataacttctgcttttgtataaaattgtaagtgaagtcaaaagaaaaaaaaaaaaaaaaaaaaaaaaaaaaaaaaaaaaaaaaaaaaaaaaaaaaaaaaaaaaaaaaaa

SEQ ID NO: 28360 - DNA, 2512 bp, Homo sapiens
aaggcagggggcggggcgtctccgagcggcggggccaagggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggcagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgtcagtgtctttcttcttttttgaaggtacatacttcacagtttccatcttgtatttacctaaatttggaacacagtatgcaggaacatcaggcatcattttgaagaactttgaaatagaactttcaaagcaaaaacttgagatattcaaaaattgtgattccccaacacccacttacttacatatttttggtcaagtatttattccctgctttggttcacatttgtaatttcagatttattagaaagctaatttatatatttttcttccccttcatttacaaactgtctgttaacagattggcaaccaagactaagttttaaatccagaagagagaaatgtttcacgcaagcagtcccccaactcccaacacacactccctttcattccgagcactaaataggtagcttacttgacaagcttcctttaattacacacagacatgggggttggggtaagaagatggtggtaaatatgaaaagtaatctttaataacttctgcttttgtataaaattgtaagtgaagtcaaaagaaaaaaaaaaaaaaaaaaaaaaaaaaaaaaaaaaaaaaaaaaaaaaaaaaaaaaaaaaaaaaaaaa

SEQ ID NO: 28361 - DNA, 2920 bp, Homo sapiens
gatttatggaaagcacctggtgcgtgttctgccctctgaggaccctgccctttcccaaaaggggtatcttaagaaggaaaatatggctgctctttgccggacagcagagtcccagtaggatttccattttccaaacctggtatcatctcctagttggaagaagtggtaagcccacgaacacaaatgcaggagggagaggtgccaagaagcagcggtacacagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtaaaaaaaaaaaaaaaaaaaa

SEQ ID NO: 28362 - DNA, 4456 bp, Homo sapiens
gatggggcttttttccagatcttcgcgccgagagccggggacggccaacctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtagatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatgatgtagacatttttaaatgtgaagctttaacaggaataggatagctgtttcaaaccttgtgcaattgtaaataaattgtttagctgtgtttctttcatttttaataaaaaattaaaaagaaaaaaaaaaaaaaaaaaaaa

SEQ ID NO: 28363 - DNA, 2372 bp, Homo sapiens
cgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaaaaaaaaaaaaaaaaaaaaaaa

SEQ ID NO: 28364 - DNA, 5272 bp, Homo sapiens
cgcgacccacatccgatcggtaccggagcgggaggtgaggggtcggctcgcggatccagctgcagagcgacgtggggaattggaatggtgctttggatcttatggaggccatttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctatagagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatcacgtttcagattcctgcctctgtcctctacaagaaccagaccagaaatccagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattgaacccttgtactttgccttattttacaaattgaggattaccaattaaactttaactgaactaaggctaccaaatacattccctgttatctaaattataacatacaattattttataacaaaatatatctaatttttattggataaatatgaataaatattttctctcagggaaaataatttttgaaagtagggtgattgagtactaactaggaaggtattaacaccactttgtagttgtcctttacgtaactactcctttactgccaattaactatcaccataaaagtaataaaaaatgaaattatttagaacggggcaggcaaactacatcctgcaggccaaatctgtcccaccacctgttttcatatggcctgtggcctaataatgttcttacgttttccattggttgaaaaataatcaaaagaacattttgtgacgtgaaaattttatgacatctattatgtatcagttttaaaaattagaattgtatgaaattaagagtttcagagttcataaagtttgattggaacataccatgctcatttgtttacatatcatctgcagctgttttttgtttttaatatggaacgcttcacgaatttgcatgtcatccttgcgcagggaccattctgatcttctctgtaccattccagttttttagtatatgtgctgctgaagtgaggactgcagctgctttcttgaacaatagcagagttgagtggttgcaacacacactgaatgtgactgtcatcacttcacactgctgtttgacacatcacaaatcactgatgtggttgtaacgacagcattttgagtgccatgtatatcacatgaacccacattttattttttattaccagagcatatctattatagcaaaacaagaaaagtggactttgttgttatttttaaagtacagtagggtgtgaattattttgatgttgaattagacgacaaagcatctatatagctaagctaaaagaataaccattgacattaccagacaaaccactcatcacagtattcccaactcacaggcaagcaactgttagaaaaattagaaaatttaaaatggaaataacaaagcagaatttcttcacaaaatgaaaatgaggctgcaacaacagtaagtctctaagtcaatcatttgttagccaagcaaagccatttattgatggtgtgaattaattatgtttggatgcagcagctgaatatatccagagaaaataaacttaagattactggcctttggcaagaacagttgcttaaagagttaaggacattgaaagcgacataaatagtcactttaaaaaggaaatgattctggatggttctttgactctatttttatttttacttagagacagggtcttgctctgttgcccaggctggagtgtagagacacagttacacctcaatgtaaccttgaactcctaggcttgagatcttcccatctcggcttcccaatgtgtgaaggttacaggtgtgagcccttatatgtggccctcgtgaatggtttagcactatccccttggtggtgtccttacgataatgagttatgagatcttgttgtttcaaagtatgtggcactcgccccccacactctcttgctcctgccttcgccatgtgaagtgccttctcctattttgccttctaccatgagtaaaagcttcctgaggcttccccagaagcagatgccagtgctatgcttcctatagcctggagaactgtgagccaattatacctcttttcttataaattacccagtatcaagtatttctttatagcaatgcaagaatggcctaaaacacaaggcaaaacaactttgatatggtacagtcattttgacaatcgatatttgaatcacaatatttgatgacaatatccttacacatttgtcatactatcaaagagaaagaaacaagatttccattcccacaaattttagtgagtatattttctgagttcagcatttttagggacctaggtgcaagtgcaaaggaaatttccctgtttcaaaatctatttaactgcaattgaggtgattcaacctaattttcagtaagaagtgattaaaataatgacatgctaaaaggcaaatttcaagggaagaaatgtaaaagaattttacaaatgctttccaagtgatgaatatgctcagttaatttcatatgctcctggattgatagcagtatttggcaatacctatctgtatgagaagacatttttaaagatgaaatgtgtaaaatcttattaccattagtattaatggttaatgatggttaatgataaccattaataggcaatcatttacaactgattttgatcacagggaacacttacttagaaccctgattagaggcaatgttattctcaccaaaaaaggcattacaaaaaattgggctatattttgaattttgtcaattaaaaaagcgtgggagcagtgtgaaggagaagaggcaagaacgacccctggaccgaccaaagcccgcgcgctgctgcgtcccacacccggtgcccacatcccgccgccgccgccgccgccatgcccaagagaaagactgaaggggatgctaaaggagataaagccaaggtgaaggatgaatcacagagaagatctgcgaggttgtctgctaaacctgctcctccaaagccagagcccaagcctaaaaaggcccctgcaaagaagggagagaaggtacccaaagggaaaaagagaaaagctgatgctggcaaggagcgggaaggtgctggagatcccaagtgaagtgtgtgcattttttataactgtacttctggtgactgtacagtttgaaatattctttatcaagttttataaaaatgcagaattttgttttactttttttaagctatgttgttagcacacagaacacttcattgttgtttttgggggaaggggtatgtgtcactaatagaatatctctgaagctggattgatacggggaaaacatctttcccttctagttttgagagacttcctcttggctcccaggaggagggatttcctgactttgacacacatggccaccttggcacaaaagccttgtggtatggaaaaacaaattcgtttttatgtcttcttttccctttccatctttcagcatagacttaatccccttaagcccagacatctgttgggacctgacccccggtcattggttaccagtgtgtctggcaatctggactttccagtgatgccactgagatggcacctgtcaaaagagcagtggttccatttctagattatggatcttcggataaattctgccattttcatttcacttcctgaaagtcagggttggcttgtgaaaagttgttaaacaacatgctaaatgtgaaatgttaaccctctaaactttccctgttcagagcatcagatgaggacttcattgggttttatagcggctgatttttggtagtccattgaagaagagagtttgaaagttgtatactgttaatgactgtctgcccatgtcctgcctgaaataccatgattgtttatggaaagtatctttaataaagctggatacagtttgaaag

SEQ ID NO: 28365 - DNA, 1812 bp, Homo sapiens
acccccacaccatggcgagcgtggtggtgaagacgatctggcagtccaaagagatccatgaggccggggacacccccacgggggtggagagctgctcccagctagtcccagaggctccccggagggtgaccagccgggccaaggggatcccgaagaaaaagaaggccgtgtcgttccacggggtggagccccagatgtcccatcagcccatgcactggtgcctgaacctcaaacggtcctcggcctgcaccaacgtgtcactgctcaacctggccgccatggagcccactgactccacggggacagactccacagtggaagacctcagcggccaactcacactggctgggccccctgcctcccctaccctaccctgggatccggatgacgcagacatcacggaaatcctgagtggggtcaacagtggattggtccgcgccaaagactccatcaccagcttgaaggaaaagaccaaccgggttaaccagcacgtgcagtctctgcagagcgagtgttctgtgctgagcgagaatctggagagaaggcggcaagaggcagaagagttggaggggtactgcattcaactcaaggagaactgctggaaggtgacccggtctgtggaagatgctgaaatcaaaaccaacgtcttgaagcagaattctgccctgctggaggagaagctgcgctacctccagcagcagctgcaggatgagacgccgcgacggcaggaggccgagctgcaggagccggaggagaagcaggagccggaggagaagcaggagccggaggagaagcagaagccggaggctggcctctcctggaacagcctgggccccgccgccacgtcccagggctgccccggcccgccagggagtcccgacaaaccctcgcggccacacggcctggtccccgcaggctggggaatggggcctcgggctggcgagggcccctacgtgagcgagcaggaattgcagaagctgttcaccggcatcgaagagctgaggagagaggtgtcctcactgaccgcccggtggcatcaggaggagggggcggtgcaggaagccctgcggctgctcgggggcctgggcggcagggtcgacggcttcctaggccagtgggagcgggcacagcgcgaacaggcacagacggcgcgggacttgcaggagctgcgaggtcgggcggatgagctgtgcaccatggtggagcggtcagcagtgtctgtggcttcactgaggagcgaactggaggggctgggcccactgaaacccattctggaggagttcgggcggcaatttcagaactctcgaagagggcctgacctctccatgaacctggatcggtcccaccaaggcaactgtgcccgctgtgccagccaggggtcgcagttgtctacggagtccctgcagcagctgctggaccgagcactgacctcactagtggacgaggtgaagcagaggggcctgactcctgcctgtcccagctgtcagaggctacacaagaagattctggagctggagcgccaggccttagccaaacacgtcagggcagaggccctgagctccacccttcggctggcccaagacgaggccctgcgggccaagaacctactgctgacagacaagatgaagccagaggagaagatggccactctggaccatctacacttgaagatgtgctccctccacgatcatctcagcaacctgccacttgaggggtccacgggaacaatggggggaggcagcagtgcaggaacccccccaaaacaggggggctcagcccctgaacaataaatggcctctcatgctagcatga

SEQ ID NO: 28366 - DNA, 2069 bp, Homo sapiens
cgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacatt

SEQ ID NO: 28367 - DNA, 1159 bp, Homo sapiens
ggcccttcgcgcgcagtcccttagggggcgcctggaagcccgcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagccccgacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 28368 - DNA, 1163 bp, Homo sapiens
ggctttccttcgcgcgcagtcccttagggggcgcaatggaagccccggcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggaaagtgagcaggcggctttgggggaggaggcggtgctgctgttggatgacataatggcggaggtggaggtggtggcggaggaggagggcctcgtggagcggcgggaggaggcccagccccgacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcgtgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 28369 - DNA, 1363 bp, Homo sapiens
gagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagccagcggctccacatcgatgagatcctcagccactcgtggctgcagccccccaagcccaaagccacgtcttctgcctccttcaagagggagggggagggcaagtaccgcgctgagtgcaaactggacaccaagacagacttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgattacaaaaaaaaaaaaaaaa

SEQ ID NO: 28370 - DNA, 1264 bp, Homo sapiens
tcctagtggagggctgagtccagcatcccagactcgtgtgactatataggcaagcatttggggacctacttcactttgataccctagccttcagcagctcaaggtgttggcctttggataggaggcttccaagtagtaaagctccctgctctcagcaagcccaacaccatggggaagggagatgtcttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacaggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccgggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatcaaaaaaaaa

SEQ ID NO: 28371 - DNA, 1442 bp, Homo sapiens
ccggggcggggtcccggacccccaccctaaggcggagtgacgcccgcagtcacttcacaaggcaaaaattgttacggggcaataaaaggcacaacagcggccaatgtctggcagtgggcacatgggggtgcgggggtgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttcatcgaggtgtgcaacgggaaactgtacatcgtgatggaagcggccgccaccgacctgctgcaagccgtgcagcgcaacgggcgcatccccggagttcaggcgcgcgacctctttgcgcagatcgccggcgccgtgcgctacctgcacgatcatcacctggtgcaccgcgacctcaagtgcgaaaacgtgctgctgagcccggacgagcgccgcgtcaagctcaccgacttcggcttcggccgccaggcccatggctacccagacctgagcaccacctactgcggctcagccgcctacgcgtcacccgaggtgctcctgggcatcccctacgaccccaagaagtacgatgtgtggagcatgggcgtcgtgctctacgtcatggtcaccgggtgcatgcccttcgacgactcggacatcgccggcctgccccggcgccagaaacgcggcgtgctctatcccgaaggcctcgagctgtccgagcgctgcaaggccctgatcgccgagctgctgcagttcagcccgtccgccaggccctccgcgggccaggtagcgcgcaactgctggctgcgcgccggggactccggctagaagccgggtggttccagccattcctgcagccaagggcactgggccagggcggcgcacgcgcaagaggcgcgcttcgagggaatatgcgaagctgccgcgtgctgctgcacatgcgctttttcccttccgcttccctccctttcttcccacgggggagtccgcagttgcccttgttcggaatccacgttccccgcgatcccgggagctggaggcgcatgcgcatccgcgattccctgcgaccaggccccgagagggcgagaccagaggggacggaagcattgcgcctgcgcggaactctcagcctctgcgcggagggcgtcccttcccaaccagccgtgggtgccaggttcccggttggaacctgcaataaactcgctgttcctcgca

SEQ ID NO: 28372 - DNA, 2704 bp, Homo sapiens
agcggcttcgcgcatttcagctggcgctgcagctgctgcacagagacccacagaggccaccctcggaaccagcgcccaatgagagggcgggacctgtgttcctccacacaaagccaggcgctgggatctttgagaaccaccaccccagcctttacccttaacattccatccgaggcaaaccacactgagcagccgcctgcaggcctgggagcaaggctacaggaagcaggtgtttccatccctcccaggcgaggccgcccaacaccaacactggagaagaagaaaaaacctcatttgatggcggaagatgaaccttcaggggccctcttgaagccgctggtttttcgcgttgacgagaccaccccggctgtggtgcaaagtgtcctcctggagagggggtggaataagtttgataagcaggagcagaacgcggaggactggaacctgtactggagggcatcctctttccgaatgaccgaacacaacagtgttaaaccgtggcagcagctaaaccaccaccctggaaccaccaagcttaccaggaaagactgtttggccaaacacctgaagcacatgaggaggatgtatggcacttccctgtaccagttcatccccctgacgttcgtcatgcccaatgactataccaagttcgtggctgaatactttcaggagaggcagatgctgggcaccaagcatagctattggatttgcaagcctgctgagttatctcgtgggagggggatactaattttcagtgactttaaagacttcatctttgatgatatgtacatagtgcagaaatatatctccaatcctttacttattggcagatataaatgtgatctccgcatctatgtttgtgttactggctttaagcctttgaccatttatgtttatcaggaagggttggttcggtttgccacggaaaagtttgacctcagtaatttgcaaaacaattatgcccatttgaccaacagcagcatcaataaatccggggcctcttatgagaagatcaaagaagtgattggtcatggttgtaaatggacgctcagcagatttttttcctaccttcgtagctgggatgtggacgatctgcttttgtggaagaaaatccaccgcatggttattctcaccattctcgccattgcaccatctgtcccctttgctgccaattgctttgagctctttgggtttgatattttgattgatgacaacttgaaaccatggcttttagaggtcaactacagcccagccttgaccttggattgttcaacagatgtgttggtgaagagaaaacttgtccatgatattattgacctgatttacttaaatggtctaagaaatgaggggggagaagccagtaatgccacacatggaaattccaacatcgatgctgcaaaaagtgacagaggtgggcttgatgctcctgactgtcttccttatgattctctttcgttcacaagcagaatgtacaacgaggatgactctgtggtggagaaagctgtgagtgtgcgtcctgaagctgcacctgcctcccagctggaaggagagatgagtgggcaggattttcatctgtcaacaagggagatgccacaaagcaagcccaagttacggagcaggcacacgcctcacaagacactcatgccctacgcgtccctcttccagtcgcactcctgcaagaccaagacctccccgtgtgtcctgtcagaccgtggcaaagctccagatccccaagcaggcaactttgttcttgtttttcctttcaatgaagcaactctcggagcttccaggaatggattaaatgtcaaaagaataatccaagagctccagaaactaatgaataagcaacattcctaagtggtaaaaaatcaaatcaagaaaaagtgacatggatttttaaaaaccaaggatcctgtcctagagaaagcaatagttcaagtccctacctgtgccaccagcatgttaactatgacattgggactgaagatgtggccatatgtataaatataacagctctgacaaagcacaatatgttcaagtggtgattaaactacattacatcccatgtttatttgctcaggtgtcttgaaagaattctacaaataccacacagcctcccaccgagtcttgctctgtcgccaggctggagtgcagtggcgccatctcggctcactgcaacttccgcctcataggttcaagtcattctcctgcctcagcctcctgagtagctgggactacagcaaaaatctgcaattggcatttcccatgtgatgctgcgtgttgagggctcatctgcttctcgtccaggacgacatttccagcttcatctttgatcttaaccctcccggaggcatacttggtttcctgacagccgctgcaatacacagtcttgacggtgccatccgggtactccctcctcttgaaccgggctgtgtggatttctttctgcccgttgctgagcacaatggttttgtcgccgttcctgagaggagaaacacatggaaataaggtctcttcctgtccatccttgagatgttccaccgtcccgtcgggaaacacgatttctttggagccattggggtagaatttttctgcagaatgcagtttttcagtatatgttacattgaatctgtttagaaacatgttctatgcaaataatctataaaatattcatgagatttaaaaaagaaaaaaaaaaaaaaaa

SEQ ID NO: 28373 - DNA, 4208 bp, Homo sapiens
gtcatgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaagcagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatagtttggaagactgttgtggccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggaacagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgactccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctctccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttccaaaaaaaaaaaaaaaa

SEQ ID NO: 28374 - DNA, 1504 bp, Homo sapiens
ggttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggccctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggaccataagttcgatctcatgtatgccaagcgggcctttgtgcactggtacgtgggagaaggcatggaggagggggagttctctgaggcccgcgaggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgtataaaaaaaaaaaaaaaaaaa

SEQ ID NO: 28375 - DNA, 1733 bp, Homo sapiens
ggaatcctccctccctctgagccgtctttcttctcctccctatttcgcagatatcccgagattaggtccccagcttccaaagagaggatcagaatgtctcaggataatgacacattgatgagagacatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaagaagacttggaaaagaagagagaggcctctgagtctacagggacgaactcctcagcagcacacaacgaagagttgtccaaggccctgaaaggcgagggtggcacggacagcgaccatatgaggcacgaagcctccttggcaatccgctccccctgccctgggctggaggaggacatggaagcctacgtgctgcggccagcgctcccgggcaccatgatgcagtgctacctcacccgtgacaagcacggcgtggacaagggcttgttccccctctactacctctacctggagacctctgacagcctgcagcgcttcctcctggctgggcgaaagagaagaaggagcaaaacttctaattacctcatctccctggatcctacactcctatctcgggacggggacaatttcgtgggcaaagtcagatccaatgtcttcagcaccaagttcaccatctttgacaatggggtgaatcctgaccgggagcatttaaccaggaatactgcccggatcagacaggagctgggggctgtgtgttatgagcccaacgtcttaggatacctggggcctcggaaaatgactgtgattctcccaggaaccaacagccagaaccagcgaatcaatgtccagccactaaatgaacaggagtcgctactgagtcgttaccaacgtggggacaaacaagggttgcttttgttgcacaacaaaaccccgtcgtgggacaaggagaacggtgtctacacgctcaatttccatggtcgagtcactcgggcttcggtgaagaacttccaaatcgtggatcccaaacaccaagaacatctggtgctccagttcggccgagtgggcccagacacattcaccatggacttctgctttccatttagcccgctccaggccttcagcatctgcttgtccagtttcaattagaagctggctgttgaataactcaataaaataccatacccttgccagcaaaaaaaaaaaaaaaaaaaaaaaaaaaaaaa

SEQ ID NO: 28376 - DNA, 2945 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaaaaaaaaaaaa

SEQ ID NO: 28377 - DNA, 2368 bp, Homo sapiens
gcgccgccaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccagcttctctaacgatgtctggaatggctggtctttttagcatctctggcaagatatggcatcttcacaactatttcacagtgactcttggaattcctgcttggtgttcttatgtgtttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttcttt

SEQ ID NO: 28378 - DNA, 1893 bp, Homo sapiens
cttgtggcgagcagtccagcacagcctcacagtgcagagcatgagctttggagcctgcccccaccctagctttgtgaccttaagtgagctacatagcttctcatgtgtaaactactcatcataatggttctgacctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctgaaaacaaaaaaaaaaaaaaaaaaaaaaaaaaaaaaaaaaaaaaaaaaaaaaa

SEQ ID NO: 28379 - DNA, 1962 bp, Homo sapiens
aaaacaggaaggccacagtggaggccaagccttccccatgggcaccttctcagattgcgattgtggatgaaatgagggattttcttgaaacaaccctcacgcaggtgacgcaagacgcggagctcggctgcacgacgctggcgcaagcgcgggggcaagagcgccggcctccgagacggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttaggtacttttatagacaacttctgctcttctacagcaaaaatcctgctatgatggaaaaatcaatattttgtacagaaccaacttctaatctactcactcttaaacagaatatcaacatttgcctttacatgaaccagttgcctaaaggatcagcccagattaagtcacagttacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtg

SEQ ID NO: 28380 - DNA, 3201 bp, Homo sapiens
gtaccgtgtggggctgcccagccggaagaccctgtaccagctgcaggcggagcggattcggcgggtggagcagctggccggtgagcgccacgggacccgctgcaccgtcccctggtgtgtcctgcctgccctacctcggcccggaggtacccttccccacgcccccccacatccccgctccagacgcgagccccaaccccggcacagaccgggacattgcccagaaccggcccaaaatggggcctggccccagccccaactggacactggaccccgaaccccgatgccggctctggtccgagccccgtctgcctgcagggccaggcgtactcgcggccggctcaccgcgcctcccttgcaggtacgtcatgaccagcgagttcactctggggcccacggccgagttcttcagggagcacaacttcttccacctggaccccgccaacgtggtcatgtttgagcagcgcctgctgcctgctgtgacctttgatggcaaggttatcctggagcggaaagacaaagttgccatggccccagacggcaacgggggcctctactgcgcgctggaggaccacaagatcctggaggacatggagcgccggggagtggagtttgtgcacgtgtactgtgtggacaacatcctggtgcggctggcggaccctgtcttcatcggcttctgtgtgttgcagggcgcagactgtggcgccaaggtggtggaaaaggcataccccgaggagcccgtgggcgtggtgtgccaggtggacggtgtcccccaggtggtggagtacagcgagatcagtcctgagaccgcacagctacgtgtctccgacgggagcctgctgtacaatgcaggcaacatctgcaaccacttcttcacccgaggcttccttaaggcggtcaccagggagtttgagcctttgctgaagccacacgtggctgtgaagaaggtcccgtatgtggatgaggaggggaatctggtaaagccgctaaaaccgaacgggataaagatggagaagtttgtgtttgatgtgttccggtttgctaagaactttgctgccttggaagtgctgcgggaggaggaattttccccactgaagaacgcagagccagccgacagggacagtccccgcaccgctcgccaggccctgctcacccagcactaccggtgggctctgcgggccggggcccgcttcctggatgcccatggggcctggctcccagagctgcccagcttgcccccaaatggagaccctccggccatctgtgagatatcgcccttggtgtcttactctggagagggtttagaagtgtacctgcaaggccgggagttccagtccccgctcatcctggatgaagaccaggccagggagccgcagctgcaggagtcctgacccgcccagactgcccccagactcccccgagacctgccagccccggcatcctggaagtcccgactccccccagacctgccagccccggcgtcctggagctgggggctacagcccagcctgagctctgggtgggaaagcagcctgccccatgcttccagcctgcagaacacagaatgaaacatgctggtagactccacgagggcagggcctctcctgtcgcctctggacacaagtggcgacagcctgctgggggctctgtggctccattcctggctgtggggtctagtcaagaggcagagggacttgggacctgggagaatggggctgagaggaggcttcgggttggggcccaagggaggtgtggtgtcatctggggagaacaggagggcatgtccctttgggagcccgccttgtggatccaccacaccccaccgagcactagaagctgcataagctacacaggatgtgcttctgcagcctacagatgcagaaccagaatgagggggacaattccacccactcgagggctgccccctcttccttagcagacgaaccagtaatgggggcaaggctggggcatcccagcccacacaccctggatgcccagcaaggccacagaaagagcctgatgtccatgatccaggtggctctgagaagcttggcctggacacctgagcctgcggccggtactcctgccttctccccatctatccccaaggcctctgcctctcagcctcttccatggtcggtttaggctgctgagttttctgtgcttccccaagaaccagtgggatcaatgccggcggcctctgtgatggttgctgactaatccgggatttcatgagtcagaggcaccacccctcaccccagctgcctgctgcttctgacggatcttggtgctcaggctgcctggctctccgagtgaggacgcagcctccatatttggtgcactcaggcatggctgggacaagccagctgccccagggttcttcccctggtgattctcgcctgctttctcatctcaggggaggcagtggcacctccctctccctgctgacatgaagagagctatgatatgccactgctgccaactcatcctctgcccccacctcgaaacccacagtccccagtggagggccactactcatccccattggtttcccaggggaggggtgttgtctggaagggcaggttcagatgcagccttccagatttagaggcactgggaggacagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgac

SEQ ID NO: 28381 - DNA, 2919 bp, Homo sapiens
agcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcgcacacaccgccaagcagctcagcattctcccccggcacacttagtgacagtgatgctctgtgctggtaccaaacaaggcagacttgcaagaaccatggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaatttttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcacgccactgcactccagcctgggcaacagagtgagactctgtctcaaaaaaaaaaaaaaaaaaaatggaacgcagggcaagaactcgtatttggaaggagatgggggaaaggagcggtattatacctatgttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgcaaaaaaaaaa

SEQ ID NO: 28382 - DNA, 3034 bp, Homo sapiens
agcagtccccggtgtcggggcaggaggcacgcgcgcggctgaggcgaggtcgctcggcgcagctgttgcggggccatggcggggaccgcgctcaagaggctgatggccgagtacaaacccttgagaacgtgcagtgagagcttgaggaagaaggcctgacttgctgctgcggaattaggagggaaaagtgtatgcgttaaaaggggaaaggctcgttggtggagctttgaaagaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcgcacacaccgccaagcagctcagcattctcccccggcacacttagtgacagtgatgctctgtgctggtaccaaacaaggcagacttgcaagaaccatggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaatttttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcacgccactgcactccagcctgggcaacagagtgagactctgtctcaaaaaaaaaaaaaaaaaaaatggaacgcagggcaagaactcgtatttggaaggagatgggggaaaggagcggtattatacctatgttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgcaaaaaaaaaa

SEQ ID NO: 28383 - DNA, 3256 bp, Homo sapiens
cggcggcggcggcggcggcggcggcggcggagcccggagcgcaggccggaggctcccggcccgccggccccggagcggagcggagcggaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagtaaagaaaaaaaaaaaaaaaaaaaaaaaaaaaaa

SEQ ID NO: 28384 - DNA, 1163 bp, Homo sapiens
ccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaaatgaaaaatctttctttggaagcagcataggggaagagcatgagcttcagagtcaaacagatgttggagaaattcttaaccactctgaacttgtttttttatctgttaaatggagataaccttacctatcttgcaaagttgttttgcatttgacgcttattattttatatatatgatttcattcgagatataaataaaaattatataaaaatgtgaaaaaaaaaaaaaaaaaaaaaaaaaaa

SEQ ID NO: 28385 - DNA, 1510 bp, Homo sapiens
tttgttgatagggagaagccaacatctcccgcaggaccccctaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactggtcctagctaaacactttgaaccacaggatgccaaggccgtgctgcagctgctaaggcaggagcacgaggagcgcctgcagaagataagcctggagcacctggagcagctggcccagtacctcctggcagaggagcctcacgtggagccagctggagagagggagcttgaggcgaaggcacggcctcagagctcctgtgacatggaggagaaggaggaggcagcagctgatcagtaaacgggccatcctacccatttgcatgctaaaattctcccggcctcatccttacgtgttccctggtgacttttcctactacttcctgctgatgtggatgcgtccacacccctttttgaaccttccaagcagctggagggtttttggatccctgtcccctcttgggcctgaggtcctccctctgaaatgcagagtgaaccaaccctcatcaccatgcttcccctagaagggttctgatcaccggagggcagccccaaaggccacagtcccctcctgtgctggcagctttgcccacacatacccagcagctccccaggctgaaagcagccctggcccagggtctccatggttctaggcagaccctctttctccttcgggacagaaagacaatgtgagttcattttcctccatcctcagaccgtgacatctcccctaggctccccagcagccaagaggagaggaatgtcaggtagctgccccttgccttctgggtgaggctgcccctgctgttctcctgcttgtgcttccagcttaagggacaggcacagcagaggtgagagtgggaggagggcacgtaccgggtgccagccctggagccctcagggagacagacacagaccaagaatagcaggaaactgagcctcaggcagaaaaaaagttcagcaaagtcatacactccctgtggccagcgtgaacagagccatgccccaccctcccagactgatcagtcagtaggtatcacagctcacattacctgcccagcgctgcccaaggctccctggaaggaaaaatggtatctgtcaatgaggatccttgccctcacagagcacgcagcctagatgcagagagctgctatacatgtgaaaagtaaagtggtgacatgaaactagaaa

SEQ ID NO: 28386 - DNA, 1099 bp, Homo sapiens
gcacagcccagggccatgctcctgttctcagtgttgctgctcctgtccctggtcacgggaactcagctcggtccacggactcctctcccagaggctggagtggctatcctaggcagggctaggggagcccaccgccctcagccccgtcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctgctgacaaaaactctgtgaaaacggatctgatgaaagtgccaatggtcatcatggactgggaggagtgttcaaagatgtttccaaaacttaccaaaaatatgctgtgtgccggatacaagaatgagagctatgatgcctgcaagggtgacagtggggggcctctggtctgcaccccagagcctggtgagaagtggtaccaggtgggcatcatcagctggggaaagagctgtggagagaagaacaccccagggatatacacctcgttggtgaactacaacctctggatcgagaaagtgacccagctagagggcaggcccttcaatgcagagaaaaggaggacttctgtcaaacagaaacctatgggctccccagtctcgggagtcccagagccaggcagccccagatcctggctcctgctctgtcccctgtcccatgtgttgttcagagctattttgtactgataataaaatagaggctattctttca

SEQ ID NO: 28387 - DNA, 622 bp, Homo sapiens
cggacgcgtgggcaacgctcggcttgtgggacgcccgcggtcggatgccctccgtccgctccctcctccgcctcttggccgccgcggcggcctgtggcgccttcgccttcctgggctattgtatttacctcaaccggaagcggcgcggggaccccgcgttcaagcgccgcctgcgggacaaaagaagagcagagcctcaaaaggctgaggagcagggcacgcagttgtgggatccaacgaagaataaaaagttgcaagaacttttcttgcaagaggtacggatgggagaactttggttatctagaggagagcacagaatggggattcaacacctcggcaatgcccttttagtgtgcgagcaaccacgggaacttctgaaagttttcaaacacactctccctcccaaggtatttgagatgctgttgcacaaaattccccttatttgccagcaatttgaggcagacatgaatgaacaggactgcttggaggatgatcctgattgaaaaacatttcaacgtatccacagtccagtgagaatactatggtaccatacagtataaacaactgctcagtgatatttccatttattttactttgagtaataaaaatttttctatctcat

SEQ ID NO: 28388 - DNA, 18883 bp, Homo sapiens
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatgataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggcattaaggccagctttcgaacaaaagtgcctgaaggtttgattgtctttgcagcatcacctggcaatcaggaagagtattttgcacttcagttgaagaagggacgtctttattttctttttgatcctcaggggtcaccagtggaagtaactacaactaatgatcatggcaaacaatatagtgatggaaaatggcatgaaataattgctattaggcatcaggcttttggccaaatcactctggatgggatatatacaggttcctctgccatcctgaatggtagtactgttattggagataacacaggagtctttctgggagggctcccgcgaagttataccatcctcaggaaggatcctgagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcagggttcctggaacttcatccatatatgtttcatggtggaatgaactttgagatttcctttaagttcagaactgaccaattaaatggattgcttcttttcgtttataacaaagatggacctgattttcttgctatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacagaatacctgtatcgagtgatagcctcgcatgaaggaggttcagtatatagtgattggagtcgaggacgtacaacaggagcagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggcatattgacaggcttgctacccttcaaaaactatgcagtaaccctaactgcttgcactttggctggctgtactgagagctcacatgcattgaacatctctactccacaagaagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagttattttccaatccttctgcatcgttaagctatgaagtgagtgatctccaaccgtacacagagtatatgtttcggttggttgcctccaatggatttggcagtgcacatagttcttggattccattcatgaccgcagaggacaaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgagatatgagcttctgagacgtaaaatccagcagccacttgcatcaaatcccccagaagatttaaatcggtggcacaatatttattcaggaactcagtggctttatgaagataagggtcttagcaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaactgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatggggagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttgaagtctgcacaatatatgcctgcgtgaaaagcaatggaacccaaattaccactgtggaagacactccaagtgatataccaacacccacaattcgtggcatcacttcaagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtctccagccatacaccaactacagcttcactcttacagcttgtacatctgctgggtgcacttcaagcgagccttttctaggtcagacactgcaggcagctcctgaaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtgctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaattgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaaccttctttttccaggtcatctgcacgactgacgaaggaagtgttaagacgccgttgatccaatatgatacctctactggacttggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactgtatgtggatgaagaggacctgatgaacgccatcaaggatttcagctcagtgactaaggaacgcaccacattcacagacacccacctgtaaaggatggaaacccagaagacgtaaccctggaatgcaaggtctgcacccatttcctcctgggttatcactcacacatcataaatgctgaaaagccattgtttattatcctataattctttaaagaaatgatgactgtttttgaaagtgttccttcctaatagaggtctaagaaatgatatttttctcatcttaaatgagagagaatattcatatgaaaatacttgatttgctcttattttgtagaagacaaagaagtatgtaattgtcacttggttctgtttggcagtgatgctcctggttaactgaataatcagtggcaatttcaagatggctcacagttgttagaagtagtaagttagttactggctcaaaaatgattctgttgaaaggatgtcactgctgttcatttctatctgccatttctgtcagggttgacacaatcctgcaagaatagttattctaatgatcacagctgctaaatgaatcccaaactttgcaccaggtcgacaaacttttctgaaggttctatttatttaccatacatagggttacttaccaaactttttgacaaggctgaaggttctatttatttacaatacatagggttactcaccaaactttttgacaaggcaacacataacttacacataaatgtctctgttcttgcatttatgaattttccaaaaatctaaggagtaaacagcttatttatacattttgaggagaaaacaaagtgtttcactaggaacacctctacttgaaccaatgtttttatttcatatattttatagttttgaaactagtttctcataaaattctgtcaattcactgaatatcagagaatactgacatcttcaacctagcacatttcaaatggaaactactgttctatttgcaatattaggctgcgtgaaattttaaaaggaaaaatgtatctgttccttctagcattaacatatatacatgtagagacaagactatacctatgtgtatatatatgtatatcatgtatatattactctgcactatatcccttctttttggagaactagccattattttagccacagaatcagtaagaacagatgatatgcaacagtaccaattacggttcaaaaatgtctgtcacctgctctagttggattacaaagtcattggtgaaagtcctatggcaagaaaaattttcttgcaaatcatccacataaaatcagatatttaaatttgttcttcatggaaaacagagtaagaaaacctcttgtcttccttcatccttaaaggtctttgtgaccccaggaaaatattgactctgtctaacacacaatagtcacaatactttttgtgaatctacaaccagagacaggcaaaaacttgtaaagtaagggatagtcttacttattctgcctgaaaacaatgtattaccccagggcccaacagtaaaagattgtggactttttgggtattgagatttcatctagctctgtgagagagcagctcctcagactgaccaactcctagacaaagtttgccaaccataagtgtcaaaagcacaggccagtattaagcagaagttctaccaccttattagaactgctataaacaaaagcatctgaaataattgtgcacatctggcagtgactgtagaaaatacgaaatatatatttctcgccaagtttttatactttctgaaatgaaaacataggattgactagtttactggtttttattcccatatgccgattctgggacaataaagttgtttaaagctggcacaaataagcattaaccaaggctgtgtccaccttctgtgagctacttaaggtatataggaaaggagtggtcacaaacttgcatcctaatccttggtggactcttctaagaatacagtttgctagtcacaaagaatagtctacaaatatgctttgctaggttcagaagattgagtttatcctgatttttgaaaaattaaccaggtatctttatcactgtgtatttttccaagcacagtataaaattttaacaacgcacaaaaaaatacagaactgcaggggattttatcttggatcattatccatttaatcatctaattagacatgaactcagttagctgaatcatttacattttgactccatagcttagggcagacagaagcctgtatggcttctgcccagaactctgtcccctgctacatgtctaagtttacttgtatttatttcagagaagaactctaagatgttgctttgctactttaagtggtattgcgtgccaagcctctattatacaaaccatgcagactcgcctctagagattctgattcggttgatctggggtgtgtggctgaggcatcagtactttttaaagcttccaggtgttctaatgttgagacccactgatgttccacaatctggaagaaatcatgtacaggaataatatgctatgcacagggactatgctccttggctcaccccttctcccttataaacaatgagcagttcttgatgaacctctttaaatttaaatctcctgactcacattttaccaattgtacatgccacattctcagcttacgaactaccatgttttgttattcttaatatcaactgtttggtaagagtacagttgtttttatacactctaagaaatgtgtttataatctactgtaatttccactaaatggaacccaaatattaatgttatggtaccatatactgatgtaaaaatcatgctggcatccatgaacacaccggtaaataaaacatagtccaagtggaagaattcattaataaggaacttttaattatgtcacaaatgaatagttggtttccaatgcacaaatatcatgtaaactaatctaaagatggtttgcttaataaatatttgaatgtgacc

SEQ ID NO: 28389 - DNA, 4968 bp, Homo sapiens
gcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattct

SEQ ID NO: 28390 - DNA, 2871 bp, Homo sapiens
ccaaacctgaaagaggttgatttgtaatgatttgcaggggggcactggaggcagcggccaggacttttcacttaggagatcagcatttgccctgatggaaactgggcgatcctgcagggactgacctctgagttatccaaaggccgacctggggaaagactgattttgaggttttaatagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacgcaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggagaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaattttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctaaaaaaaaaaaaaaaaaaaaaaaaaaaaaaaaaaaaaaaaaaaaaaaaaaaaggggcggccgctctaaaaaaaaaaaaaaaaaaaaaaaaaaaaaaaaagg

SEQ ID NO: 28391 - DNA, 817 bp, Homo sapiens
atgtggatgctgggagaagtatgtgagatggaaaagttgtttcatggcatccaagaagtgaatgatcctcaaggtgtagcagaggaatttgtaggagagagggatgattgacatcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggagagcgaggtggaagaaccactgagtcaggagagcgaggtggaagaaccactgactgtgtggatggccagcttttcccctgtctccgagagcaccgactaagttcaggcccagccgccagacctcagagatctcaccagcggggtgcttgccattctgaagataataaaatgaatgtgttgcaaattgaaa

SEQ ID NO: 28392 - DNA, 3163 bp, Homo sapiens
gccgcctggcgcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctgggggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcagtgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaatttaaaaaaaaa

SEQ ID NO: 28393 - DNA, 3078 bp, Homo sapiens
gctccctgttctgcatctcgctcaacagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctgggggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcagtgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaatttaaaaaaaaa

SEQ ID NO: 28394 - DNA, 2984 bp, Homo sapiens
gcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttcctcatattattttaaatgtccattttcatttataggccaaatcctgccaggaaagtaaccagatctctggatttcactgttaagtcatttcagattgaccatattcagacagtcatggggtgaaataattcacttacctccaaaatagcgtcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggttttttagttaatttatggcgtactttgtttatccattggccaacctgaaggaaatgaaactcacctatctttctatcacagatgaatgtgctagatgaatgatttgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccctttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaaaaaaaaaaaaaaa

SEQ ID NO: 28395 - DNA, 5431 bp, Homo sapiens
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaa

SEQ ID NO: 28396 - DNA, 1587 bp, Homo sapiens
gccggggggaggggccggggcggtggcggctgtggccggtactggacccggcgggatgagcgaggtggaggcggcagcggtggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcaaaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggccaaaaaaaaaaaaaaaa

SEQ ID NO: 28397 - DNA, 6265 bp, Homo sapiens
ccgcaccgaagcgtcgcgataactgcaaccacccgcaacttctcgcgatgtttggccccgctaaaggtcgccattttggagtccacccggcgcctggtttccccggcggcgtctcccaacaggctgccgggaccaaagctggccccgcgggtgcctggcctgtgggcagccggaccgacacgatgtggcggctccgctgcaaggccaaggacggcacccatgttttgcaggggctgtccagccggacccgggtgcgggaactccagggccaaattgccgccatcaccgggatcgcccccggcggtcagcgaatcctcgtcggataccctcccgagtgcctggatctcagcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtcccagcagacaactcttgcctctttactagtgtgtactatgtcgtcgaaggaggagtcttgaatccagcttgtgcccctgagatgagacgcctcatagcacaaattgtagcaagcgatccagacttctatagtgaggcaatactgggaaaaacaaatcaagagtactgtgactggatcaaaagggatgacacttggggaggagcaatagagatatcgattttgtccaagttttaccaatgtgaaatatgtgtagtggatacacagacagtaagaattgatcgttttggggaagatgcaggatataccaaaagggttctgcttatttatgatggcatccactatgatccacttcagcgtaacttccctgatccagatacacctcctctgaccattttctcctctaatgatgatattgttcttgtacaagcactggaattagcagatgaagctagaagaaggagacagtttactgatgtcaaccgcttcaccctgagatgcatggtatgtcagaaaggattaactggacaagcagaagcaagggaacatgccaaggagacaggccataccaactttggagaagtgtgacctatgcatgaatgagggttgaagcctactacctcacacatccagaaggctctgggttttccaataagctatggtaaccctaaagaacaaaggatacaatgcttgaaccatccttttaacttaaaaccactaagacactgaaattccttgttaagattaaaattagtgtgcaagtttacagatgtgtgtctacagtggtaaactgtacatacatgcctctttctgctggagtgacagaataggtgatccttgccacctactgacactgacctgaaggttgagattgagtattataaactagcacccagcagctttaacttgtagaagaaagcatcacattttgggtaatgtggaaggcctcctgtgagtccactgggcatacgattgagattgagtattataaactagcacccagcagctttaacttgtagaagaaagcatcacattttgggtaatgtggaaggcctcctgtgagtccactggacatttaccacagtgtctccagtaactgagtctttttaaaaactctgaatgagttaagtttctaaattatgaattgattcatcaaatgaagatactcagaattgtccaaactgattttatattgcaatttggtagacattataaatgtgtgcttaaccactgataagtacatcacaagcaatttttacagggatgagtctcatccttgagaatgttatcacaaaacaggaactgattgtgccctgtttaagatctctagcatataaaacgtagaatgtatgagggaataggtgcctgagcagcttcctgaagctttaaaagaccgttggcctcgtgttttaatgcaattcatgtattggtctttgtcacattggataacattttaaagttaagcagggtacttttttaattgaaattccttgaaattcgagtcctcagttttttcttcatttgcgtaaagtttatcggggggaatttaattttctcagctttttgttaagagcacttcctccaaaaaatttttttcaagtaataatgctctgctttgggttggtttttgtaagattttttgcacacctaaagagtgtttgcttttgtgctagccttatccctccactaaagttattttaaataatttcacatttctgcaaattagcactttgcttatctgcaatcttttactttgatttttgaagttttaaagcaattggagtaatactgttgaatgaactagtttcacttccaaaatagaaaaaattgtaaatccttgccttatgcagctttctcagaattctgcttcttcctagtactagatgtgtagccatttgcttagtggactaatccgcaaggcacaccctctaaaacttagcttcactacaagatcttccagataaaagttttctacctcttttcttaattattctgatcagggatgctaaattataatttgttatgtattatctcacataatgtgaagaggcttaatgtgaagttttgttattttggtctcttttttattaagtatctcacttagaaattcagtggtatactttaaagcacttggatctttttcagcatatctgcctagcaaatgttttaaaattgacatttatttttagcactttcacttggtgaaggtggccatataaaattaaggaacatttgaacaatataagagaaaagaacttttaaggaacaattcacaaagtttgtttgaaattgtcagatgacatttcttgagtaccttttgtgtgcatagttattttagacaatataagctgttatggtcagcataacttaaaagtgtttagttttctattttactgagccttaaaaatagcactgatgagcttatgatacttaatgtttggcaatcataatgtgttcaaattaatgggattgaaaatctctccacacctgactctcatctgatctggatggttttggttttgtatcttttttacttctcccagaaaatactaaatttaaaactgtaaattaagaatataccactagataacaattatcaaattgagctttatgcatcattactcagaaagcttgccttcctttctttgctacttcaggacacagagttgacatttgcttactacagctttagatctagaagtttattcgtgcaacaaatatttattgagtaatttatactgtgccaggcatgttttgatatgtttctgtcatatgttttgatatgttccaacataagtttctgtcactttatattcagtatatattttctacagtgggtaaatttaacaaatggaaaggaatagaacactgatattttacagaattaaaccccttcattgtaagggctttgtttacatattaagtgtcaagtatttattcaggggatcttatttcattgtattttatctgttatctaggttgtccatttaccggttggacactgatactctgtcaaattcctttcaaaaatgactctttagtctgctgaaatttagcactagtactttagtgttctgatcctggaaaattcaaggtgaagctttatttgtggaccatctgatttaattattgaggattaaaaacctaaacctttgctcattctaaactcaagcttttaagcctcacagaatttacaggggtttgctttttgtttgtttgttttttcattttttactgtgcttattaaactcttggaattagttattaaagggagtaaattctcatcttgggaattttgaaaatctatggacttacaactttcaggaggattaaatgtcttaagttttgtactagagcagaatgaaatctttcctattcattgagtttttgcctgccatagaggaatttttttaaaaattaaaatgacagtttatattagtggcaaagtgaataaagacctcactttcccaccccacccttcttcctttctcttacttttctttggattaaaggtcaggtgtagtactatgaagattcactcctgaataaagtgatttcagaagctaaaatttaacatacctggaaattttgtgatgtgttagccaagtgaagacattagtgtgttccatcttttgctaatggttcatggttgatttcttcattgtttcccatgaaattagcatagtcaagtggtacccttgacgcttgactgctggtcagtttgaccctgtttttaacaactaatgtagtcatgccgcttgattattccatgaagtcccagcaaaataataatgaggaattaactaacattatgttatctatctaatttgtctgtgtccctaaatgcccatgcctaacttgcttctctagtttattccttctgtggagggattaaaacgtgggtgttgcaagttgccctaagctaaacatagttttcttacatctttttgggaaaaaaaatggaatgggaagtatgcaagattaagcaagagtgatttttttttttttttgacaaatcaggtggccttcctaaacatactaagaattatgttctttcatgtgtggagacacatttgtttgcagcactttaaaaaatatatatggaataaaagtttacatgttggccctctagggatctaattaaggacattaaagtacaattcttgagctactaaccatcagctcttcttaatcaaagattgccatcagtgtagagtgtatctattggcacaacattctggtgttttgataacagtagaactcaatttcagtaactattaggagcatggtctgtgccctagcattaaaaatgttacttattattatgtgaatatcttgtattattatacaatgcagtattcaaatttgtccttgtagtgcagagatgactgataatttctaaaagattcgatccttaaaacttgtttccaagcagacttataaggaagctgatttttgagtcagaggccttaaacgtgtcatatacaagtggcatcattttaagtccaaagtgaaacacttgatttgaataagctagtttataaactaaagctgttttcttatgttacagtatttcagcacatttcattccacataaaaagaatattaagtgtccctggttgtgggagagtgtttatttttctcaaaattatctagcattttgcttacagtgctttgaatgtttgacttaaaattattattgatgttgaattgtagggtgctgatttaggtcttgattcatacacatttaaaggaggttggtaaccccctcatggtagagtgaagggagaaaagggccaagaagacaaagtaccactgataaagaagagattgtcaaatagatgcattcctagtcatgaattacccttttccaaacatttttaaagcaatgcctttgtgtcaactcaacccttcttccccatttcttgtcatagaatgtagcatggccataggtgaaaaagcttatcattaaagtatgaaaccatgaattataagcattttgccatgatgcccttttatacatatgtttttaaaagtactaaccaacatataggagtttaggaatggtgaagatataatttgattaagttgtaggtaaacagaaaggatcatcttaggctcagaatttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctacctggaagatgtctaacttcattttctacaactcttatgtgattttgccattgtcattaagatgcattgattttatttatgaggtgtatgactttaaatatctaaatgctgtattaagtgacttgtttcaaaggaataaatgaagtgaaaacgt

SEQ ID NO: 28398 - DNA, 4301 bp, Homo sapiens
caggcggcccgcggggcggcggcgggaggatgcctcgcgccctgcctaggcgttaacggcctcagcgcgtcccgggccgcgccgggaacgcctgagagccgagcccgcgctgaccggggcccgggccggatgggcgctgcgggccggggcgcggaccgcggagcggccgttacgtttttctctcgtcccagctgtgtggacagtgccacacgccctcctggacaacgacggctcttgcgtgcattttccagtgttgcttttgtcagagaggccagcagagccacggttcttccagaaccagccctgagctgagtgaggagtgcccaggagagatggtgaaaatgacaaagtccaaaactttccaagcgtatctgccgaactgtcaccgaacgtacagctgtatccactgcagagcacacctggccaatcatgacgagctcatctccaagtcctttcaggggagccagggacgcgcctacctcttcaattccgtggtgaacgtgggctgcggccctgcagaggagagggtccttctcaccgggctgcatgcggttgccgacatctactgcgagaactgcaagaccacgctcgggtggaaatacgagcatgcctttgagagcagtcagaaatataaggaaggaaaattcatcattgagcttgctcatatgatcaaagacaatggctgggagtaatgtgcgaactttcccttctcctttgaatgctgttttgtgaaagaaactgtgaatgtaatggaaacgtaggagcatctggtgacagcctttcttgccctctgacctcaaaggctagctgcgcatagctcttgacactctcggccatctctgtgggtaaggtgtccctcggatctgtcctcttcgtgtacacagttgtttctgaaaattttcaatgagctttttctaacttctcaagttctagagaaagaattaaccaactgatgacttacctgcctagttaatatcttcctttcacctttgtcttcaatatagttgggctctgcttttttaaggttcagttgaaaaccaaactggggccgggtgcggtggctcacgcctgtaatcccagcactttgggaggccaagatgggtggatcacctgaggtcaggagttctagatcagcctggccaacatggtgaaaccccatctctactaaaaatacgaaaattagccgggcatggtggcgagtgcctgtaatcttagctactcaggaggctaaggcaggagaatcacttgaacctgggacacggaggttgcagtgagctaagatcatgccatcgcactccagcctgggggacaaaagtgagacatcgtctcaaaaaaaaaaaaaaaagctgggtatggtggcgcatgcctttaatcccagctactcgggaggctgaggcacgagaatcacttgaacccaggaggcggaggttgcagtgagccaagatcgcgccactgcactccagcctggcaatagggcgagactccgtctcaatttaaaacaaaagagaaccagactgagtctctgaagaccacagggacagggtctctttagatagcaagtctcaccattcccttttttagagaaaaggtattgtagcccaccctccaccccgctgtttttcttaaatttgcagaacttcaaattggctattcctcttgcaaatgaacccttaaagtacagtgttatttaagaatcttccagaggcagtcaacagacttatacactaagggcatttttggtttttagcttgttcaaaaacagaggccagcacagatgacattttagatacactctaaattgagaatggtgtctagtggaacatgtttatttaagccagtagattccttatctagaaagcaggtgagctagcccttagagaaggctgtcccggggcccgcagaggtgcccttactgaggtgacagcctcacagggtctggtaccaggggttgtgccctcagcagtgacagcagcttaggtgtcaggcagttgctgagtggctggtccatgtctatagagtaacacactggaccgaggaaaagtcagatttcattttctaccctggatgtacttgaagaaaaagaattatttttgcatatgaaagaggccagaacccacaggaaaaacttcaaaacttgacatttgccagaatgtttaaaatttgttcagaaaaggttaaagcaacaagtttagcctttgtgcatgaagacgcctggcctgctagacgcgttgcccgtccctgcgtggtgctgtcccatgtcacttgaactgatagaggggcctgtgcaatctcctaaggcctgtgtttctgccatatattttattataaattacaatccactcatccacctgccctccaccaggagtgggcaccccataagggtttaggccactttgcagaggatggaggtcaaaaaccactcccagataagtttggttttcaacatttagtaacttgtctcagggcagagggcaggcagggggaccgaggggcagcagataggagagcactgagcccggatagttctcagcctggcaagtggctctgaagctgccttcagacaaggctagtctaggggcaagagtgcgagctggctgacaataagaacgtggccacctgcccagcttcacacctcccccgacttcagcccttcctaaacccagacctgcggtccaggcaggcactgggctgtgcccactcgagctcactgcccacacacagcatgcctttgggtgccatctctttgcccaagcctggaagccttggcaggtgggaaatgccgctgccctggtgggcatggcactgagatgcatccactcagcaggagtgacagaggcagaagttcctttaaagcacatcttccacttaggaaaggaaggaaatctttgtactgtcttggaagcctccacatccggctatggccctgcaagctgctttatccctgcgctagtctcccccgagggtttaggctggcccagcacatcctgtcctcctgagctcgcgtgcagccacccagagcgcaggggtcactgcacgctgcagggctcttgctgccatggtctcaagcctgaagaggctccgcccacaagctggcccatgaagttagcaatgcctgtggcttcagtcaattgtcttgagactgtgaagaggctgaaagacaccttcccgggtggaagaaggagttcactgaaaacttatcttaaactgacccttccctttgagtgagtcttcattcctctcccatgtgggaacccagcctccgatgccccggggactaggggaaacagttggaggttcgtgccgtccccagcctgccacgggtgcgaggacagccaagtcctgagtgactcaagatgcttcacttacatggaagaaacttctaaaactctaccgagtggtttttgtatatactaaagttctatttagagcttttctgttttgggcaagttcgctgctccttctatttgggcactttggtttttgtactgtcttttgtgacggcattgattgaacattttttactagtagtcttatgacttttgtatttttttttttttttgtaatttataccaacaacacttttatcactttttttttgttgggcttctgcaaaatacaagctcatttttaaaccaaatgaacagaccatgagctggcttcaggggaagtgctattcacaggaccatatccaccaccctcttaaattcctaaacaatatcatctaggacttctatttaagttatttaaaataaatcttccttgagagccttgggaggtgatgtcagggttataaatggcacagtgcatttgctgtaggaatgtggtttggcattgttttatacacacagtattttttataccttaatgcttattcttgatggcatctgtcagatattagaattgaaaataagaatcttcccaaaatcctttaatttacctgatgccctcatcaggtcgttaaaaattcaaatggttttaatagctaaaaaactacaaattaagctctaaaacaaacaaactacagaaatgtaaaccttcatttgccaaaggtccttggtggcctgtcccctgccctgggagcagatggccctgaagcccttccctcactgtgcaggccaccgggtgaggctggacggtcacccatggtggcttcactgcaaggagcaggactgccgagctcaagcacggggccttcagcttcccctgtcctctggccacaccgccagcccttggtccttatctgtgtgaggtttacaaataaagcttctgatgtcaaatgtttaaaaaaaaaaaaaaaaaaa

SEQ ID NO: 28399 - DNA, 2183 bp, Homo sapiens
ccagggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgcaaa

SEQ ID NO: 28400 - DNA, 5052 bp, Homo sapiens
cggcgcttttccttcggactaagggagccgtcgaagagcgctcgccaaaggccagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacaaactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccattgtgtaaaaaacagtttcagtacagtgcctctttgcgagcacatcttattcgtcataccagaaaagatgcaccctcttcatcctcgtccaattccacgtctaatgaagcatcgggaacatcatctgagaagggcagaaccaagcgggaatttatatgttccatatgtggaagaacattacctaaattatattctctccgaatacatatgttaaagcacacaggtgtaaagccacatgcatgccaggtctgtggaaagacttttatctataagcatggtctaaaattacatcagagtcttcatcaatcacagaagcagttccagtgtgaactgtgtgttaagtcatttgttaccaaacggagtcttcaagaacatatgagtattcacacaggagagtccaagtacctttgctcagtttgtggaaagtcttttcataggggctctggactcagcaagcacttcaagaaacaccaaccaaagcctgaggttcgaggctatcattgtactcaatgtgaaaaaagtttctttgaagctagagatcttcgccagcacatgaacaaacatcttggtgtgaagccattccagtgccaattttgtgataagtgctatagttggaagaaagattggtattcccatgtgaagtctcattctgtcactgagccttataggtgtaatatatgtggcaaagaattttatgaaaaagctttgttcagaaggcatgtaaagaaagctacccatgggaagaaaggaagagcaaagcaaaacctggaacgggtgtgtgaaaaatgtggaagaaaattcactcagctaagagagtataggagacacatgaacaaccatgaaggagttaagccatttgagtgcttaacatgtggagtagcttgggctgatgcccgatctctaaaacgccatgtcagaacacatactggtgaacggccctatgtctgtcctgtatgtagcgaagcctacatagatgctcgaacactccgtaaacatatgactaaattccacagagactatgtgccttgcaaaattatgctggaaaaagacacccttcagtttcataaccaaggaactcaagtggcacatgctgttagcatcttaacagcaggcatgcaggaacaagaaagcagtggtcctcaagaacttgagactgtggtagtgacaggagaaactatggaagctctggaagctgttgcagctactgaagagtatccatcggtatctacactttctgaccaaagtattatgcaagtggttaattatgtattagcacaacagcaaggacagaagctatctgaagttgcagaagctattcaaactgttaaagtagaggtagcacatatttcaggaggagaatgagtatgttaatgaagataaaaagaagtgacatctcttgtacactgaactcacagaacatttgtttacaattctgtgtgactgtctgcttggagtttacatatcaaagttctgggctgtttggtaacgtaacgtttccaaacattttgtctggccaatgggttctatagaaaagaccgtttagtgtagagaaattgaaaacagatctattaggttggtgcaattgcttttgcaccaacctaatatttgatggcagtggtttatcatgatataccttttatgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatccccttttaagtcagggatgctttattctattttaaagcacttatgagttacatgttgtaatcaagtttgcacaatatatttatctatatgaggaacccataaatgaatagctaatttttaaaatgccattaaaatgcatgaaatgcttattaaaaccttactatactatttcttcaagggcaagtaaattgaccatgagaaaagaacacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattaccgttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtctttttatgttccatcctctgttgttactagatttagtttaaaaattgtgtatgaccattaatgtatgtcataaacatgtaaataaaagatgttgaatcttgttgaaagcgcggcc

SEQ ID NO: 28401 - DNA, 3105 bp, Homo sapiens
cgcggcggcagcagcagcagcagcagcgagaggcagaggcggcggcggcggggaggacagcacggccgaggctgcccagcggcgcctcctccacaccccccgccgcagcagcaccggcgacagattttttaaaaaatggatttggccaaccatggacttattctactgcaacagttaaacgctcagcgagagtttggtttcctgtgtgactgcacggttgcaatcggcgatgtatacttcaaggcacacaaatcagttcttgcttcattctccaattactttaagatgttgtttgtccatcagaccagtgagtgtgtccgcttgaaaccaactgacatacagcccgacatcttcagctatctcttacacttgatgtacactgggaagatggcgcctcagctcatcgacccggttcgattagaacagggcatcaagtttctgcacgcctacccgctcattcaggaagccagcctcgccagccagggagccttttctcaccctgaccaagttttcccactggcttcttcattgtatggcattcagattgcagatcatcagttgagacaagccaccaagattgcttcagcacctgaaaaactcgggcgagatccacggccacagacctccaggataagccaggagcaggtccctgaggcctcacagctctcccagctgacttcaaatctggcccaggtgaatcggacaaatatgactccctcagaccccctgcagacctcgctgtctccagaacttgtttccactcctgttcctccccctcctcccggggaggagaccaatctggaagcatcttcctccgatgagcagcctgcgtccctcacaatagcccacgtcaagccaagcatcatgaagaggaatgggagctttccaaagtactatgcctgccacctgtgtggacggcgcttcactctccggagcagcttacgtgaacacctccagatccacacaggagtacctttcacatctagccaacagggagaaagtcgcgtccccctgactctctgtagcaatgcagctgacctcgggaaagatgccatggaagtgcctgaagccgggatgataagtgacagtgagctgcagcacatctctgattctcccatcatcgatgggcagcagcagtcggaaaccccacccccctcagacattgctgacattgacaacctggagcaggccgaccaggagagggaggtgaagaggcggaagtacgagtgcacaatatgtggacgcaaatttatccagaaaagccactggagggaacacatgtacatacacaccgggaagcctttcaagtgcagcacttgtgacaaaagcttttgcagggccaaccaggctgcccgccacgtgtgcctcaaccagagcatcgacacttacaccatggtggacaaacagactctggaactctgcacatttgaggaagggagtcagatggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttcttagtattcatcctccaggtgtcttacttcagaatgcatcctttgagattatgtccacttaagagaaatcatcagttaagaaatctactttaacaaaacaaaaaggagaaaaagtaataatgtgatggcaatcttaatttttgggtacaacatgacaagctgtgagtttgtgtgtttgtaagagaaaaatgtgtgggtacttgctaataaacaggtgaattaatgcacatccttatctcattgctggcttctttccaagttgagcaacaacaaaatgctgtatttgagtttctgacaaatttgttttaaaaatcaaatttgaatgtactattctataaattgcctttctgaatagaacatgacatgccattttctagcagctgccagtgataatttgttttacactaacttttaaatcagtgtgtgtactgcagggaaaaggatataggaatactcatcttacaggggaatttgtgaccagaagatgtagtaacttcaatgactgaaagtcaatgctgatagtttactggcaacattaattgaagcatcaaaaataaatggcaaagagaaatcaggacaaaaaatctaattgctgtttgggaaaaaacttgattttgatgtttattctccaggtttttggttgtttttttttctttcttctttcttaatgcctgaaattttctccattggcccgaaagcagtaaaaattgttcattaatcttccgttaggccaataaaagaagggcctcacaagacaaaacaggagccagaagtaaggactgaaggagaaggggagaatagctaatagctatagtatatgtatatgttaaaaactgaatatcccatcatcctatttcatgtatagttgagttctcaaatttgtaagtttttatacatcctttcattgaataaacgtttaattaaatgagtaaaaaaaaaaaaaaaaaaaa

SEQ ID NO: 28402 - DNA, 1960 bp, Homo sapiens
gccgtcatctctaagaaacaaccataccactgaatgctactgtgtacttacaaaccacactcatattcgtcacgtcatttcatcttcacccccacctccaaatgaggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggatcccactgtccctaaatgcccccaaagggctctggagccagaaccagttggcctcctccagccctaccccaggttccctcccccagggccccgcacagctcagccctggggagatggaagagtctgatcaggggcacacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttca

SEQ ID NO: 28403 - DNA, 2357 bp, Homo sapiens
cgccgttttcccggggagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagacccaattttgcccattcgtaagcgagtcaaaatacagacccaaaaaaaccaagccaagagggcttgggggtgatgcaggcacagcagatggccgaggcaggacactgcagaggaagataatgaagagatctctaggcaggaaatccacagctcctcctgcacccagaatgggaaggaaagaaggccaagggaattcagattctgaccagccaggccctaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaaaaaaaaaaaaaaaaa

SEQ ID NO: 28404 - DNA, 1780 bp, Homo sapiens
ttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggagctgcagaagcaggcagagctgatggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaacacgggaaaaaaa

SEQ ID NO: 28405 - DNA, 8046 bp, Homo sapiens
ctgcggcggcgcgctccgagcctgcgtctagggcgcccccgggtcagagctgtcgccgtggccgccgctgcaaagaacaatgtaccgcaagcagcgctcgctcctccgtttcttcccaccggcctaaagacgacggcgggggcggcccgcgcagcggccgcagctctggctcctcttcaggcccggctcgccgcagctcaccgccgccttccgccctccggctcctcgtcgcggaccccggctcgccgaccccgctcgccctcaaggcaccgcggccgccgggcctcgccgtccccgccacgggttcgtcgcgtctccccgtccccgcctcgggcccgtcgcggctccccgtcgccaccgcggggccgacgactcttcccgccgggcccggccggcttcagaggcagcagccgaggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggggttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccgggaagcccgccagaagaagatgtactatcttaggaccgagttagagcggcttcataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacattttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagttttgtattaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacagacactggatccctacaacagaccttgggcttcaaagacccagagtgaggccaagcaagatgccataaagcgcactgacaagataactgttcctgcaaaaggctctgagtttctggttcccatcagtggattttattgccagctctgtgaggaatttttgggggatccaatttctggggagcaacatgtgaagggtcaccaacacaatgagaaatacaagaaatatgtggatgaaaacccattatatgaggagcggcggaatctggaccgccaagctggcttggctgtggtcctagagacagaacggcgacggcagagtgagctaaagcgcaaacttagtgagaaaccaaaggaggagaagaaagaaaaaaaggcaaaggctgtgaaagaagtaaaggaggatgacaaggtctctgagaaattagaagaccaactctctgagggtaggaactcccctgaaaaagctgaaaataaaaggaacactggcatcaaactccagtttaaagaagaagtaaagaaggaatcaccaacatcatcttcttttgggaaattcagctggaagaagcccgaaaaagaagaggagaaaagttccttggtgaccccaagtatctctaaagaagagattctagaaagtagtaaggacaaagaggatggcaaaactgaagctgggaaggcaaagcctatcaaaatcaagctctctgggaaaactgttgttgcacataccagcccttggatgcctgttgtgacaacttccacacagactaagatcggacccaacctgcctattccatccacagtactccgcaagtcatgttcagccacaatgagcaagccagctcctcttaacacctttctgtctattaagtcctctggaaccactgctaaacctctgccagtggttaaagagtcttcagctgatctcctcttacctccagacatcatctccaaagcatttggaggggaagaggtgattctaaaagggtctccagaggaaaaagtggtgttggctgaaaagagtgagccatctcatttacctgaacaaatactaccacctcctccaccacccccacctccaccacctccaccaccccccgttatacctcatccagctgccccgtctgctgctcaagcaaatgctatcttggctccagtaaaatcaaacccagttgtatctcaaactctcagccctggcttcgtgggtcctaacattttgaacccagtgttgcctgtagccatcatggcctcagcacagccagctgccattccttctgatgagacagctcctggggtgagtgagagtgaccgagaccagaccctgttctctgtgttagtacgtcctccaccacccctctcaagtgtgttcagtgaacaagccaaaaaattagagaagcgaaattcatgcttagccacagccaatgctaaggacctgtatgacatattctatagtagtggtggaaagggggcccctgagactaagggggcccctgagactaagctaagtggtggtccattggccaatggggaaaatagcaacctctctagaaccaaaagttcagacacctcttctacttctcctttgaacagcagtgcatcccaagaggagttgcatcaagatgagggtttggtcgctgctcctatagttagcaactctgaaaagcccattgcaaaaactctggtggccctagggaaatggtcagttgtagaacatgtaggcccaaaaagcacaggcagcacctatggcttcctacagcctctgacaaggttgtgccaaagcaggccttatgaaacaattaccccaaagacagacactttggccatatggacctctagttccttccagagtgacactagtagggatatatctccagagaagagtgagcttgacctgggagagccaggaccacctggtgtagaaccacctcctcaactgttagatatacagtgcaaagaatctcagaagttggtagaaatccacctcagagaatctgttaaccaggataaggaaagccaagagctccgtaaatctgaggattgtagagaaagtgagatagagacaaacactgaactaaaagaaagggtaaaggagctgtctgaggggatagttgatgagggagcaagtaccagcattggaccccacagcatagatgattctaatttgaaccatggaaacagatacatgtgggagggagaagtaaaacagcccaacttgctaatgattgacaaagaggctgaacagtccaataaattgatgacaggaagtgaaactccaagtaaagtagtgatcaaattgagtccacaggcttgctctttcacaaaggcaaaattagactcatttttatcagaagctaggtctttactcaacccacaagatacacctgtgaaaatttctgccccagagttgctgcttcattccccagccagatcagctatgtgtttaacaggtagtccacaagagcaaggagtttcagttgttagtgaggaggggctagagaattcagctccagaatcagcttctagaacttctaggtacagaagtctcaaactcaagagagaaagatcaaaagactttcaagttaaaaagatctatgagttggctgtttgggatgaaaacaagaagaggccagagacctgggagagcccagagaaaccaaaaacagaagcactggagctacaagatgtccatccagagttaacagtgacaatagaaagcaaggccctagaagactttgaagctacagacttaaaggtagaggagcttactgccctggggaatctgggggatatgcctgttgatttctgcactactcgggtaagcccagcacatagatccccaactgtcttgtgtcagaaagtgtgtgaagaaaattctgtatcacctatagggtgtaattcctccgatcccgctgacttcgaaccaatcccatctttttctgggtttccgttagattctcccaaaaccttggtgcttgactttgagacagagggtgaacgaaactcacctaatcccaggagtgttaggatcccttctcctaacattttgaaaactggacttacagaaaatgttgaccgtggcttggggggcctagagggaacacaccaggcccttgacctgttagcaggaggaatgatgcctgaggaagtaaaagaatcttcccaattagacaaacaagagtcactcggattggaattaaaaacaattaattttgcaggccttgggccatctccttgccttccagaccttgttgactttgtcacacggacctctggagttcaaaaagataaactgtgttctccactctctgagccaggtgacccttctaaatgtagttccctggagttggggccattacagctagaaatatcgaatgcatccaccacagaggtggcaattctgcaagtagatgatgacagtggcgaccctctgaatttggttaaagctccagtgtcaaggtcccctccaagggagcaggtaattgaagacaatatggtccctcagggaatgcctgaacaggaaactacagttggtgccatccaggaccacacagaatccagtgttcacaactaagaataaatacctagagctacttgtgagtgaatcattggcttctagaaatcagatgcccagatgatccaagactagtttgttatctcatctggaacctacaccaagagatgcagtcagcatcttaaagtaaatgttcatggaagctaaaaaatttacctcctttccttttccctttccccttaaaacaccagacaaatcgataacaacttatatatatatatatatatatctgtaaaaatgtattttgttaatttttttggccaatttattttctcccactttgtcattaaaatcacatgtctaactggctcaccacatagtgtgctttgattgtattttggctttgactctgccatttctgaaatgtgggggaggatggaggcagctgacctctccagttgctgtgttgtattcctacccaatttcctgggcagttgatgcatctctgggaaaaacaccagaaagcttgctgaaatggaaaacttggaagaattgttcatctcttaggcttccatttggatgggcctgccttaacattgtttgaaatgcagcgtgagtagctcttttgtttactgtttacaccccttattggcatgtcaactcctgtacttcccttactctgttgcctttcttgagatgcattgtcctgctaacccacaaacctgtttggaaataaacatggaagaatatctggcaggcttacttttagaagacgacaaatcggtaaggcttattcatggttcattgccaggagcagatatgcttttgagatcacttttatttttgaaatggcctttgttcattgtattgtgatccaataacactttgtattaaattgtttagcagccatttgtgttgtgaaggggtagaagatctctgaaacttgtctttagattgaactcattccctgttccacaaacccatatgtatcctttcctcaacctcctcctttcccaattaatttcaaccatagtacgatgtttggggttgtatattttgttaaaaagattaaagaatttatgagttggcttggacaagtttaactttatttttaatgtgttaattacttggaataaatgcattaatttcagaaaaaaaaaaaaaaaaaaaaaaaaaaaaaaaaaa

SEQ ID NO: 28406 - DNA, 4752 bp, Homo sapiens
atggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccagaatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggaaaaaaaaaaaa

SEQ ID NO: 28407 - DNA, 2005 bp, Homo sapiens
gaggtacgcggtgcggtctcccggtacccggagcggctctgattcatggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatcttgtaaaaaaaaaaaaaaaaaa

SEQ ID NO: 28408 - DNA, 3183 bp, Homo sapiens
agtcaccagcggaaccctctccaccaggctccgcgtcgaggccctacggggcgtcaatacgcacgcgtactttgtgtcccaggtactctgcatttccaggacctggtcactattcaggacacggttccagcgcagtgcgcgttagccatgtctcagctccagactgagaggacgcagcatagaaaatgcttatgagtggttcagactcagtaatgggatgagtgacattccaagatgtggccattgacttctccaaggaagagtggggattcctgaaccctgctcagagagatttgtacacaactgtgatgctggagaattatcagaacctggtctggctgggactttccatttctaaatctgtgatttcactgttggagaaaaggaaactgccttggataatggcaaaagaagagataagaggcccattgccaggatatttcaaggtgtcagagatgaccatctcccaggagccaaaggcaaagactagaactctctttggaaaagatgtgccaggtgcagagattagggagttatctgcaaagagggctattaatgaagtattatcgcagtttgacacagtgataaaatgtacaagaaacgtatgtaaggaatgtggaaatctatactgccacaatatgcagcttactctccataagagaaatcatacacaaaagaaatgcaatcagtgtttagattgtgggaaatacttcactcgtcaatcaactctcattcagcatcaaagaatccacacgggagagagaccctataaatgtaacgaatgtattaaaaccttcaaccagagggcacaccttacctagcatgagagaattcacaccggtgagaaaccttacaaatgtaaggaatgcaggaaaaccttcagccagatgactcatctcacacagcatcagactacacatacgagagaaaagttccatgaatgcagtgaatgtggaaaggccttcagccgtgtctcagctcttatagatcaccagcgaattcatagtggagaaaagccgtatgaatgtaaggagtgtggaagagccttcactcaaagtgcccagctcattagacatcagaaaactcattctggagaaaaaccctatgagtgtagtaagtgtaagaaatcttttgtgcacctgtcttccctgattgaacattggagaattcacactggagaaaaaccatatcaatgtaaggactgcaaaaagaccttttgtcgtgtgatgcagttcactctgcacaggagaattcatactggtgaaaaaccctatgaatgcaaggaatttggaaagtccttcagcgcccattcttctcttgttactcataagagaacacacagtggagaaaaaccgtataaatgcaaggaatgtggaaaagccttcagtgcgcactcttcccttgttactcataagagaacacacagtggagagaaaccctatacatgccatgcctgtgggaaggcctttaatacttcctccacactttgtcaacataatagaattcatactggtgaaaaaccctttcagtgcagtcaatgcgggaagtcctttagctgcagctctcaccttactcgacactgtagaatgtgtaatggaaaatttagcaaataaccaaaactcaaaatgttaattctgattattctgtatcatcaccagtactttgtactttgagtctttttaaatatgctctgttagtttgtatggaatgatatttcattgcacttttaatttaacttaaaaatgccttcccttgactgttgatatgtattttttgtgaagtgtgtgttgaagccttgcagattattttttaaattagaggtttatcactaggtatatctcctaatgctatccctcccccctccccctaatgtaaatgacgagttaatggtgcagcacaccaacatggcacatgtatacatatgtaacaaacctgcacgttgtgcacatggtaccctaaaacttaaagtataattaaaaaaaaaaaaattagaggtttttcttcgggtgcatttatgagagttcaccagattttggaaatattttctattctgtaacctaccttttcatttacataacagtgataaaagctttaagtttgatcacatccaattaatcacattttttaatagttatgcttttatttgtttttcagacagggtcttactctgtcacccaggctggagtgcagtggcacaatcatggctcactgcagtctctgcctcccaggctcaagtgatcctcccacctcagcctctcaagtagctgggactacaggcatgtgccaccacacctaatttctatattttttgtagagactaggtttcaccatgttgtccaggcttgtcttgacctcctgggctcaggcagtccatctgcctcagcctcccaaagtgctgggactacagacatgagccattgtgcctgacctagttctgctttttatgttctaagaagtattatttattctatgctgagcttacatagaatttcttccatgttttctatagctatagtgtatttttaccttttactgttagatctatttcatgtttttattatggataatggaggaggtaaaggttgaattatattttcccccatattattgacccatagtgacaccagttttgggagatgtctttcattttcgcccttacgttgttattggcaccttttgcaaaaatcaattatttatcatgagtatacttctgaaatgatctgtttcatcaatctatttgtcttctcagtagttccacattgtcttaattatagctttagaggaagtcttgaaatttggtagtaagtcttccagttttgttattttaacaaatttctctaggctgggcatggtggctcatgcctataatcccagcactttaggagccccagacaggaggatcacttaagcgcagaagatcaagaccagcctgggaaatatagcaagaccttatctctacaaaaaaatttagaaattagctgggcatggtggcacccatctgtagtcctaactgctcaggaggctgaggtggggggattgcttgagtccaggagttcaaggctgcagtgagttgtgatcacaccattgcagtccagccaggttgacagaatgagaccctgtctcttaaaaaaaaaaaaaaaaatcctggtgatgcttttctggattaaaaaaaaaaaaaaaaaa

SEQ ID NO: 28409 - DNA, 2864 bp, Homo sapiens
ggtcgctggcgcctgtttcctcagagccactttttcctttgtgttgtctggtcgttcactactttgagggaaaagaattttgccgttcgcgttcgattgactccgtccccaagatcctgtagccccacggacctggcgactccaccgtgttcgggtctttctaggaacccaatctgccttcatgaagaaaagacagaggcagaaaggaagatggcttactgcctgacaaattgttatcagtactccgtgacctttgaggatacagctgtggacttcacccaggaggagtggattttactggacccagttcagagaaacttatacagagatgtgatgctggagaattatgagaacgtggccaaagtaggatttcagctctttaaacccagtgtcatctcttggttggaagaagaagagttgagaaccttgcagcaaggagttctccaagactgggcaataaaacatcaaaccagtgtttcagcactgcagcaggagttttggaaaatacaaacttctaatgggatacaaatggacctggtaacctttgacagtgtggctgtggagttcacccaggaagagtggactttactggacccagctcagagaaacctgtacagtgatgtgatgctggagaactacaagaacctgtcctcagtaggttaccagctcttcaaacccagtctgatctcttggctggaggaagaggaagagttgagcacactgccaagagttctccaagaatggaaaatgtgcctgaaaaccaaagggccagccctttggcaagataatttttgtttaaaaacattaaatgggatacagttggcaagaaaccaaaatggagaggaactctatgactgtaagcaatgtgaagatgtcttctgtaaacatccatgccttaagaccaacatgagtactcaaaatagaggcaacacgtctgaatgtattcagtatgcaaaagacctcctttctctatacaataaaacctctaccataaggaaagtttctgtgttcagtaagcatggaaaatctttccgcctgattttaaatgttcaggtccagagaaagtgtacacaagataaatcctttgaaggcactgactatgggaaagccttcatttatcagtcataccttgaagcacacaggaaaactcagagtggagaaaaactcaatgaatggaagcaatgtggggaagcatttactcactccacaagccatgctgtaaatgttgaaacacacattattaaaaacccctatgaatgtaaggaatgtggaaaagattttagataccctacccaccttaataatcacatgcaaacccacattgggataaaaccttataaatgtaagcactgtggcaaaaccttcactgtgccgtcaggctttcttgaacatgtacgaactcacactggagagaagccctatgggtgtaaggaatgtggtaaagcctttggtacatctgcaggccttattgaacatataagatgtcacgccagagagaaaacctttaaatgtgaccactgtgggaaagcctttatttcttacccatctctttttggacatttgagagttcataatggagagaagccatatgagcataaggaatatgggaaggcctttggtacatcctcaggtattattgaagatagaagaagtaacacaggacagaaacgctttgattgtgaccagtgtgggaaagtctttgtttctttctcatctctttttgctcatttgagaactcacactggtgagaagccctttaagtgttacaaatgtgggaaaccatttacctcttctgcctgtcttcgtattcacatgcgaactcacacagaagagagactctatcaatgtaagaaatgtggtaaagctttcactaagtgctcatatcttaccaaacatttacgaacacacgctggagagaaaccctatgaatgtatgaaatgtgggaaagccttcactgagcgctcataccttactaaacatttacgaagacacagtggagagaagccatatgaatgtaagaaatgtggaaaagccttcacagaacgctcagatcttactaaacatttacgaagacacactggagataagccctatgaatataaggactgtgggaaagcctttgttgtctcctccagtctagttgatcatttaagaactcacactggatataaaccctataaatgtaatgcatgtgaaaaggcttacagtaggtcttgtgtactaactcaacacttaaaaactcatgcagcagagaagacctctgaatgtaacgcatgtggaaattcctttcgaaattccatgtgctttcatgatcgcttaaaaactctcaccaaaataaaaccctataaatgtaaggactgtgggaaagccttcacttgtcattcagatcttactaatcatgtgcgaattcacactggagagaagccctataaatgtaaggaatgtgggaaggccttccgtacatcctcaggacgtattcaacatttaagaactcatatgggagagaaaccctttgaatgtgaccagtgtgggaaagcctttgcttctttctcagctcgtattgcacatttgaaaacacactagagagaagccctgtggatgtgaagaatgtggaaaaacctttgctgtttcctcaagcctaactgaacatgtaaaaattcacaggagaaagtaacactatcaatgtaaggaatgtgagaaagcctgaacagttgaatctttctagatatgtacaaactcacactgtagagaaaccctgtaaatgtaagggatgtaggaaaacactagttcttctctctctcttttttttttttgatgagtctcgctctgcactccagcctggcgactgagtgagactccatctc

SEQ ID NO: 28410 - DNA, 4352 bp, Homo sapiens
gatctgcgcatgcgcactcgaggcaaggcggccactcccagaagtctccggggctcgagcggtgggtgggaggcgcggtccaagtggtcgctgccgtatttctcgtaggtttttaggattctggactccatttctcaccggtacctgcggtcctgactgttctggcttggactacatattccaaaggcaacggagaaaacttggacccctggctccggttccgggaccttttggttccacatgaagaaggcggcgcaggtcactgcgggagcctctgcagccccagcccgccgcccgcgtggtaccctgcgtggcggtgagagtggggctgcaggaggcgctcagagcgcggaggcccccaggcgggccgggcgagtctcccgcctccccaggccctagggtgctggagctgcggaggaggggcccgtctctaggagacaggcggggagcgtgagagaccgcgcagcggcgacaggaccggcttgcctgtgtgacgtgggtgcagttgcgggactgtgaggggtcttggttcttttgactttgctcttctggtagagaaacgccaaggactgatcaactcttgccagtctcaaaccatggcctatggatcaataacattcggggatgtggccatagacttctctcatcaggagtgggaatatctcagcctggttcagaagaccttgtaccaggaggtgatgatggagaactatgacaacttagtctcattggcaggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaaagtacatcagagtattcatactggagagaagccacatgaatgtaaggaatgtggaaaggcctttcgtcagttttcccaccttgtgggtcataaaagaattcatactggagaaaaaccctatgaatgcaaggaatgcgggaagggctttacatgtaggtatcaacttaccatgcatcagagaatttattcaggggagaaacactatgaatgtaaagaaaatggggaggcttttagtagtggccatcaacttactgcacctcatacatttgaaagtgttgagaaaccttataagtgtgaggaatgtgggaaagcctttagtgtgcatggacgacttactcgacatcagggtattcatagtggtaagaaaccctatgaatgtaacaaatgtgggaagtcctttaggctcaattcatcccttaaaatacatcaaaatattcataccggtgagaaaccctacaaatgtaaggaatgtgggaaggccttcagtcagcgtgcacaccttgcccatcataacagaattcatactggttacaaaccctttgaatgtaaagaatgtgggaagtcctttcgttgtgcctcatatcttgttatacatgagagaattcatacgggagagaaaccctatgtatgtcaagagtgtgggaagggttttagttatagccataaactcactatacatcgcagagttcatactggtgagaaaccttatgaatgtaaggaatgtgggaaggcctttagtgtatctggacaacttactcagcatctgagtattcacagtggtaagagaccctttgaatgcaacaaatgcgggaagtcttttaggttcatttctgtacttaaagcccatcagaatattcatagcgctgagaaaccctacgaatgtaaggaatgtggcaaggcctttcgtcatgccacaagcctcatatatcatgaccgaactcatgctggtgaaaagtcctatgaatgtaaagaatgtggggaaacttttagtcatgcttcacatcttattattcatgagagaattcataccagtgataaaccctatgaatgtaaaagatgtgggaaggcatttcactgtgcctcatatcttgttagacatgaaagcgttcatgctgatggaaatccctatatgtgtgaagagtgtgggaaagcttttaatagtagccatgaacttagtatacatcatagagttcatactggtgagaaaccctttaaatgtaacaaatgcagaaggtcctttaggcttagatccatccttgaagtacatcagagaattcatatttgatagagaaattgtggcatatacaggtagtaaagaaagcacattgtgtcaatggatttatcccactgaacaatttgaatgaagacaatgtggaatggctttgagatacagttcagtttttattaggcatcaatttgtattggtgtgaacttttcaaaatgtaaatcatatatgcagtttctttggtatgacctgtgttaactcagattcagagaatttataatgtatttttttaataacataagaaaacttttctgatattcctctagttttggattgccaaaatattcatagtagaggaaaactgagaaaacgtaggaaaccattctttatacttgcatgtaaacatcttccagcaacaatcatttattgttaaacctggaaaaagccattacacaggaaacctctgttgatataagcgatgatgggaaaggctatttagccactctgcatatttaatgctcatgatcaacatctgcttcctatagctgggatgatatgggggaagatatttatcccttctggggatcatatataaatgatgatagtagtacctacagtatagtgctgttagaattacatgagttagatgtggaggtcagagtggaagcaggtgtgagagggtcccgcagaagaaaacatggctgccaaagtgtttgagtccatcggcaagtttggcctggccttagctgttgcaggaggcatggtgaactctgccttatgtaatgtggatgctgggcacagagctgccatctttgaccaattccgtggagtacagaacattgtggtaggggaagggactcactttctcatcccatgtgtacaaaaaccaattatctttgactgctgttctcaaccacgtagtgcgccagtcatcactggtagcaaagatttacagaatgtcaacatcacactgtgcatcctcttccggcccatcactagccagcttcctcgcatcttcaccagcattggagaggactacgatgagtgtgtgctgccgttcattaccacggagatcctcaagtcactggtggctcgctttgatgctggagaactaatcacccagagggagctggtctccagccaggtgagcaacaaccttatggagtgagcagccacctttgggctcattctggacgacgtgtctttgacacatctgaccttcttgaaggagttaacagacaggtggccccccaggaagcagagagcgccagatttgtggtggaaaaggcggccatcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaagctacatgaaatatactgttacgttcaataaacattagcttctgtat

SEQ ID NO: 28411 - DNA, 1517 bp, Homo sapiens
attttttgaggaagtagacaaacctaaatatgtgtctgaactccaaggaatatgaacaagatgcctgctggtgaacaagaatgtgaatataacaaagaagggaagtactactctaaaggagttaaactggtgagaaaaaagaaaaaaattcctggttaccgttggggggacattaagataaacatcataggtgaaaaggatgatttaccaattcatttctgtgacaaatgtgatttgcctattaaaatctatgggcgaataattccgtgcaagcatgctttttgctatcactgtgctaatttatatgacaaagtcggatataaagtatgtccgcgctgtcgttatcctgtgctgagaattgaggcgcataaacgaggttctgtcttcatgtgtagtattgttcagcagtgcaagagaacatacttgtctcagaaaagcttacaggctcatatcaaacgccgccataagagagctcgaaaacaagttaccagcgcttcgcttgaaaaagttcgtcctcatattgctccgccacaaactgaaatctctgacatccctaaaagactgcaagacagggaccatctaagctatattccaccagaacagcacaccatggtgtcactaccgtctgtgcaacatatgctacaagagcaacataatcagccacataaggatatccaggctcctcccccagaactatctctaagtctgccttttcccatccagtgggaaaccgttagtatttttacgagaaaacatggcaatttaacagttgatcatattcagaataactcagattctggtgctaagaagccaacacctcccgactattatcctgagtgtcaaagtcaaccagcggtatcgtcccctcatcatattatacctcagaaacagcattatgcgccacctccatctccatcatcaccagtaaaccatcaaatgccatatcctcctcaggatgtagttactcctaactcggttcgtagccaagtgccagctctaaccacgacctacgatccatcatctggatatattattgtaaaggtgccacctgatatgaattctcctccactacgtgctccccagtctcaaaatggtaatccatctgcaagtgaatttgcttctcaccattataaccttaacattttacctcagttcaccgaaaatcaagaaaccttgagccctcagtttacacaaacagatgcaatggatcatagaaggtggcctgcatggaaacgactgtcaccttgtccaccaacgcggagtccacctccttcaaccctacatggtcgatcacatcattcacaccagagaagacatagacggtattaaggatgataacagtatttggaactgaagacctgatgggaaaaaaaccttcaagttctatactgtactgtggataagcggctcagttcagcagagctggagttgaacaactttgttcctctggtgtggtaaattgacctaaaggtgacctctgacgatttcctgaaataaatatgcaatgttacattttc

SEQ ID NO: 28412 - DNA, 4983 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggttagctaaccatgcagcaggtgcttgagtttcacctttctccagtccagcagaattacattttgatgacctccattttgatacttgtagaccagatctaatccgaagattaatctttaggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgagaaaaaaaaaaaaaaaaaaaaaa

SEQ ID NO: 28413 - DNA, 2002 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaaaaaaaaaaaaaaaaa

SEQ ID NO: 28414 - DNA, 1222 bp, Homo sapiens
tggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaaaaaaaaaaaaaaaaa

SEQ ID NO: 28415 - DNA, 4585 bp, Homo sapiens
tggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgagaaaaaaaaaaaaaaaaaaaaaa

SEQ ID NO: 28416 - DNA, 1608 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaaaaaaaaaaaaaaaaa

SEQ ID NO: 28417 - DNA, 4758 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgagaaaaaaaaaaaaaaaaaaaaaa

SEQ ID NO: 28418 - DNA, 3510 bp, Homo sapiens
ctcggggggctactggcgctctcggcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaaagcagagtgtttctataagagatagtgcacaccagtatttcatccatgacaagccatttataaggaatttgttaaaactgaaaaataacataaggtatgccggaaacaaatacgtgaagtgttttgaaaataaaattggattaagcttacaggcacagctggctgaactacagagatttcaaactggggagaaaatgtatgaatgtaatccagttgagaagtctatcaatagttcctcagtttcaccacttcctccttgtgtcaaaaacatttgtaataaatataggaagattttgaaataccctttattacatacacagtatgggagaacacacattagagaaaaatcatacaagtgtaatgactgtggaaaggcttttagcaaaagttcgaacctcactaatcatcagagaattcactctggacagagaccttacaaatgtaacgagtgtggcaaagcctttaaccagtgttcgaacctcactaggcatcagagagtccatacaggagagaaaccatatcaatgtaatatatgtggcaaggtctgtagtcaaaattcaaatcttgcaagtcatcagaggatgcatactggagagaaaccttacaaatgtaatgaatgtggtaaggcatttatccagcgttcacacctttggggtcatgaaagaattcatactggagagaaaccttacaaatgtaatgaatgtgacaaagcctttgctgaacgttcaagccttacccaacataagagaatccatactggagagaagccttacatatgtaatgagtgtggcaaagcttttaagcagtgctcacatctcactaggcatcagaatatacatcctggagagaaaccacacaaatgtaatgtgtgtggcagggcttttatccaaagttcaagtcttgtggaacatcagagaattcacactggagaaaaaccttacaaatgtaataaatgtgataaagcttttatcaaacgttcacacctttggggtcatcagagaactcatactggagagaaaccttacaaatgtactgaatgtggcaaagcctttactgaacgttcaaatcttactcagcataagaaaatccatactggagagaaaccttacaaatgtactgaatgtggcaaagcttttacccaatttgcaaacctcactagacaccagaaaatacacattgaaaagaaacattgtaaacataatatacatggtaatgctttattccaaagttcaaaccttggagatcatcaaaaaagttataatagagaaaaacatatcaaatataatgagacaaaaattaagtattcaagctgtacctagcatcaggggctccattgtgaaaagaaaccatataaaacgaaaatgtggtaaagcctttagctatggcttatgtctcacttgataccagaatatacatctttgagataaaccacacaaagataacatgtatggcaaggcttatccaaagttcaagccttgtggaacatcatagaattcttactgtagagaagccttacaaatataatgaatgtgaacagctttataaaaatatttaccctattatggttataacagaagacattcaggatggaaaccatacaaatgtggcaagtcctttaagcaatgttctgacttcaggatacaccattcatattggagagaagcattacaagtgaaggtggtaaattattttaaatttctcaatggaaattcatccttatatgcaagcattttgtcatacaaaaattcaggctagagggaactaagtcttttttccttcttgaagattaagtgattgatgttaaattcacagacaattttaaaaagtcacaaactcatggtgtgtgtcagaggagcaaggacatctgtggaaagatgtaacttcagtgttaaaaattttttattcagttatttcatatttttaaaagtatgaaatctgttgctgttaaatcttcatggcatgcttttcatttatcatgattgtctcaaggaatggatgtaagatggaagggactacttccttaggtgtggcttctttatattactgaaacctggaaaaagcaagaacactaattttttctttttttggagacagagtcttgctctgtcacccaggctggagtgcagtggcaccatctcagctcactgcaacctctgtctcccgggttcaagcaattctcctgcctcagcctcacgagtagctgggattacaggcatgcgccatcatgcctggctagttttttgtttttttgtttttatatttttagtagagacagagtttcgccatgttggccaggctgatcttgaactcctgacctcaggtgatccacctgccttggcctcccaaagtgctgggattacaggcatgagccaccgtgcccagccaagaacactaatatacaatatactataagagcatgggggtttgtgccagaagagaggtaaaactattgtctaacatatatgctttatgtggtcaggaccccttagaattgttgatgtgactggggacctttgtcgattataggagagattggttacagtacaagatgaccatgaaacaagaagagtagggtgggacattgagagattttcatggaagtgaaatggtcggttactagagactgcatatgtggtagaaagaaatggagggggaatgatagtcaccctctcttgaaaggtagttactgttgcatatcacagattattgaacatagataggtcttatttttggaaactgaagagagaatggttaccatagaggacagttccatcaaaagaaccagagtagtgttcttataggggattcacatttggcccctgagattgcatttgataccattttatttagaatatattatacttcttatgtcttaattagtaaaatataatcatttttagtaacccgaaaaaaaaaaaaaaaa

SEQ ID NO: 28419 - DNA, 1725 bp, Homo sapiens
ggggaggtagcacaaagggaggaccatggtcttctaactgaggaacctgagcagatgccttgacccagaccagagacccaagccaaggaaagcccatgatcaccagagtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccacccaacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcgataccgtgggttccaggaagaaatcactggaaaagcttccaggcctggagggaaagagaggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctgtcaaaaaaaaaaaaaaaa

SEQ ID NO: 28420 - DNA, 1441 bp, Homo sapiens
atcggccagaaaggccacctgcgccagcacctcctgagaccggccttcaaagacacgacgcatgccgctctgccgtccggagcacttaatgcctagagccagcagggtcccagtggccgcgtcactgcctctgagccacgcggtcattccaactcaactgccctcgcgttctggccacaggccccctgggagaccccggagatgcccaaaggcctcatgcctgccgcctccagtgggacctagcagcacacagacagcgaagcgggtgaccatggggtggccacggccgggccaagccctcgtggcagtcaaagccttgctggtcttgtcgctgctccaggtgcccgcgcaggcggtggtacgggccgtgctggaagacaactcgagctcggtggactttgcggatctgccggcgctgttcggcgtccccctggcccccgagggcatacggggctacctgatggaggtcaagccagccaacgcgtgccatcccatcgaggccccgcgactgggcaaccgctctctgggctccatcgcgctgatccgccactacgactgcaccttcgacctcaaggtgctgaacgcccagcgcgccggcttcgaggcggccatcgtgcacaacgtccactccgacgacctcgtgagcatgacccacgtctacgaggacttgaggggccagatcgccatcccctcagtgttcgtgagcgaggccgcctcgcaggacctgcgggtcatcctgggctgcaacaagtcggcccacgcgctgctcctgcccgacgacccaccgtgccacgacctgggctgtcaccccgtgctgaccgtgtcctgggtgctgggctgtaccctggccctggtcgtatcagccttctttgtcctgaaccacctgtggctctgggcccaggcctgctgcagccacagacggccggtgaagacgtctacctgccagaaggcccaggtccgcaccttcacgtggcacaacgacctgtgtgccatctgcctggatgagtacgaggagggcgaccaactcaagatcctgccctgctcccacacctaccactgcaaatgcattgacccctggttctcccaagccccccggcgctcctgccccgtgtgcaaacagtcggtggccgccacagaagacagctttgactccaccacctacagcttcagggacgaggacccctccctaccgggccaccggccccccatctgggccattcaagtccagctacgctcccggaggctggagctgctgggccgcgccagtccccactgccactgcagcaccacgtccctggaggcagagtataccactgtctcctcagcccctcctgaggcccctggtcagtaaagatctagggcagggaggggggtgcaatgaggaatgtttctggtctgaaaagaataaagtgggtttgaaagcggaaaaaaaaaaaaaaaa

SEQ ID NO: 28421 - DNA, 1177 bp, Homo sapiens
ccgcgcggacggtgggcaggcgacggcggcgtgtggatggaggccttcgcccttggcccagcgcggcggggcaggcggcggacccgggccgccggctccctgctctctcgggccgccatcctcctctttatctccgccttcctggtgcgggtgccctcatcagttggacacttggttcgattaccaagagcttttcgcttgaccaaagattcagtgaaaatagtgggatcaacaagttttccagtgaaagcgtatgtcatgctccatcaaaagagtccacacgtgttatgtgtaacgcaacaactgcgaaatgctgaactgatagacccatcattccaatggtatgggcctaaaggaaaagttgtttcagtagaaaaccgcactgcacaaataacatccacaggaagccttgtattccaaaattttgaggagagtatgagtggaatttatacatgtttcctcgaatataaacctactgtggaagaaattgttaaacgtcttcaactaaaatatgctatatatgcttatcgtgagcctcattattattatcagttcacagctcgatatcatgcagtcccctgcaatagcatttataatatttcttttgagaagaaacttcttcagattttaagcaaactgcttcttgacctttcatgtgaaatttccttacttaagtctgaatgccatcgcgttaaaatgcaaagagctggtttgcaaaatgaattgttctttgcattttcagtttcatctctagacactgaaaaaggacccaagcgatgtacagaccataactgtgaaccttacaaaagactttttaaggctaaaaatctcatagagagattttttaatcaacaagtagaaattcttggcagacgtgcagaacaattacctcaaatatactatattgaaggtactctccaaatggtttggattaatcgctgctttccaggatatggaatgaatgtccagcaacatccaaaatgtcctgagtgctgtgtgatctgcagccctggatcatataacccccgtgatggaattcattgccttcaatgcaatagcagcctggtgtatggagcaaaaacgtgcttataagccattatcttcagttattcagtggtttattaaatgcaaagtatatatttgaaatattaacataataaattattatgccaaaatt

SEQ ID NO: 28422 - DNA, 2205 bp, Homo sapiens
gcgcgtccgctcccgccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccatatatttatttgtttggaatcactcttgtgtgatataaaggcgtgtatattatctttgtattagaaccaaaaaagttatttattttggtccctatgattttattttttaagataaattaatatactgtattttttaaagtataggtttaggtttacagaataatagagcagataatatatagagttccatacacccactgcaccccataccctcattcctccttacacaatttctcctattattaagatggtgcattagtgtggcacatttgttacaaatgatgaaccaatattaatttattattaattatagcccatagttcacattaagattcattgtgttgtaaggttatgtgggttttgacaaattcataatggcatgtgtgcaccattgcagtctcatacagaatagtttcaccaccctcaaaatcctgtgcttcacttatttatccctcccgccgtgccctggcaaccactgatctttttactgtctctacagttttgccttttccaaaatgtcatgtagttggttggagttatgcagtatgtagactttttagactggcttctttcacttagcaatatgcatttaaggttcctccatgtctttttgtgacttgatagctcattttttattgctgaataatgttcattgtatggatatagcatagtatgtttatccattcgcccattaaaggaaatcttgattgcttccagttttcagtgattaaaaataaagccgctataaacaaaaaaaaaaaaaaa

SEQ ID NO: 28423 - DNA, 2271 bp, Homo sapiens
gcgcgtccgctcccgccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccatatatttatttgtttggaatcactcttgtgtgatataaaggcgtgtatattatctttgtattagaaccaaaaaagttatttattttggtccctatgattttattttttaagataaattaatatactgtattttttaaagtataggtttaggtttacagaataatagagcagataatatatagagttccatacacccactgcaccccataccctcattcctccttacacaatttctcctattattaagatggtgcattagtgtggcacatttgttacaaatgatgaaccaatattaatttattattaattatagcccatagttcacattaagattcattgtgttgtaaggttatgtgggttttgacaaattcataatggcatgtgtgcaccattgcagtctcatacagaatagtttcaccaccctcaaaatcctgtgcttcacttatttatccctcccgccgtgccctggcaaccactgatctttttactgtctctacagttttgccttttccaaaatgtcatgtagttggttggagttatgcagtatgtagactttttagactggcttctttcacttagcaatatgcatttaaggttcctccatgtctttttgtgacttgatagctcattttttattgctgaataatgttcattgtatggatatagcatagtatgtttatccattcgcccattaaaggaaatcttgattgcttccagttttcagtgattaaaaataaagccgctataaacaaaaaaaaaaaaaaa

SEQ ID NO: 28424 - DNA, 2832 bp, Homo sapiens
agtcgaggtatcttctccccaaccactgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagaggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttagctgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccactt

SEQ ID NO: 28425 - protein, 425 aa, Homo sapiens
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRFYNFLMADNMKKIILSHRQALFGDHVKKPQSLEDTDLSRLYTATSLMQIDDNVMRKFHGYNSLKEYYEEESCMRYLHRIYVPLMLVNAADDPLVHESLLTIPKSLSEKRENVMFVLPLHGGHLGFFEGSVLFPEPLTWMDKLVVEYANAICQWERNKLQCSDTEQVEADLE

SEQ ID NO: 28426 - protein, 425 aa, Homo sapiens; identical to SEQ ID NO: 28425

SEQ ID NO: 28427 - protein, 421 aa, Homo sapiens
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPVQERYVEKIIIHEKYNSATEGNDIALVEITPPISCGRFIGPGCLPHLKAGLPRGSQSCWVAGWGYIEEKAPRPSSILMEARVDLIDLDLCNSTQWYNGRVQPTNVCAGYPVGKIDTCQGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 28428 - protein, 666 aa, Homo sapiens
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGGLCVGIYATNSAEVCQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 28429 - protein, 366 aa, Homo sapiens
MASRTVIIDHGSGFLKAGTAGWNEPQMVFPNIVNYLPCKENPGPSYARRRVSLGIDICHPDTFSYPIERGRILNWEGVQYLWSFVLENHRREQEVPPVIITETPLREPADRKKMLEILFELLHVPSVLLADQLQMSLYASGLLTGVVVDSGYGLTRVQPFHQGRPLPASGKTLEFAGQDLSAYLLKSLFKEDCDRRCLFQLETVAVTQMNKCYVPQNLGEALDFRERQQSALDESNTYQLPDGSRVELTPMQRVAPEMFFSPQVFEQPGPSIPRAIVESVESCEISLRPLLVSHVMACGGNTLYPGFTKRLFRELMGDHVSSTKATVWEGSNRNFSVWLGASVVAHLSTYQSEWMSREEYGEHMRM

SEQ ID NO: 28430 - protein, 735 aa, Homo sapiens
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEPQQDFAKYIEMHVIVEKQLYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 28431 - protein, 722 aa, Homo sapiens
MAVDGTLVYIRVTLLLLWLGVFLSISGYCQAGPSQHFTSPEVVIPLKVISRGRSAKAPGWLSYSLRFGGQKHVVHMRVKKLLVSRHLPVFTYTDERALLEDQLFIPDDCYYHGYVEGAPESLVVFSACFGGFRGVLKISGLTYEIEPIRHSATFEHLVYKVNSNETQFPAMRCGLTEKEVARQQLEFEEAENSALEPKSAGDWWTHAWFLELVVVVNHDFFIYSQSNISKVQEDVFLVVNIVDSMYQQLGTYIILIGIEIWNQGNVFPMTSIEQVLNDFSQWKQISLSQLQHDAAHMFIKNSLISILGLAYVAGICRPPIDCGVDNFQGDTWSLFANTVAHELGHTLGMQHDEEFCFCGERGCIMNTFRVPAEKFTNCSYADFMKTTLNQGSCLHNPPRLGEIFMLKRCGNGVVEREEQCDCGSVQQCEQDACCLLNCTLRPGAACAFGLCCKDCKFMPSGELCRQEVNECDLPEWCNGTSHQCPEDRYVQDGIPCSDSAYCYQKRCNNHDQHCREIFGKDAKSASQNCYKEINSQGNRFGHCGINGTTYLKCHISDVFCGRVQCENVRDIPLLQDHFTLQHTHINGVTCWGIDYHLRMNISDIGEVKDGTVCGPGKICIHKKCVSLSVLSHVCLPETCNMKGICNNKHHCHCGYGWSPPYCQHRGYGGSIDSGPASAKRGVFLPLIVIPSLSVLTFLFTVGLLMYLRQCSGPKETKAHSSG

SEQ ID NO: 28432 - protein, 790 aa, Homo sapiens
MRSVQIFLSQCRLLLLLVPTMLLKSLGEDVIFHPEGEFDSYEVTIPEKLSFRGEVQGVVSPVSYLLQLKGKKHVLHLWPKRLLLPRHLRVFSFTEHGELLEDHPYIPKDCNYMGSVKESLDSKATISTCMGGLRGVFNIDAKHYQIEPLKASPSFEHVVYLLKKEQFGNQVCGLSDDEIEWQMAPYENKARLRDFPGSYKHPKYLELILLFDQSRYRFVNNNLSQVIHDAILLTGIMDTYFQDVRMRIHLKALEVWTDFNKIRVGYPELAEVLGRFVIYKKSVLNARLSSDWAHLYLQRKYNDALAWSFGKVCSLEYAGSVSTLLDTNILAPATWSAHELGHAVGMSHDEQYCQCRGRLNCIMGSGRTGFSNCSYISFFKHISSGATCLNNIPGLGYVLKRCGNKIVEDNEECDCGSTEECQKDRCCQSNCKLQPGANCSIGLCCHDCRFRPSGYVCRQEGNECDLAEYCDGNSSSCPNDVYKQDGTPCKYEGRCFRKGCRSRYMQCQSIFGPDAMEAPSECYDAVNLIGDQFGNCEITGIRNFKKCESANSICGRLQCINVETIPDLPEHTTIISTHLQAENLMCWGTGYHLSMKPMGIPDLGMINDGTSCGEGRVCFKKNCVNSSVLQFDCLPEKCNTRGVCNNRKNCHCMYGWAPPFCEEVGYGGSIDSGPPGLLRGAIPSSIWVVSIIMFRLILLILSVVFVFFRQVIGNHLKPKQEKMPLSKAKTEQEESKTKTVQEESKTKTGQEESEAKTGQEESKAKTGQEESKANIESKRPKAKSVKKQKK

SEQ ID NO: 28433 - protein, 754 aa, Homo sapiens
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDDAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNKPASKDSRGIADPNQSAK

SEQ ID NO: 28434 - protein, 457 aa, Homo sapiens
MSGTRASNDRPPGAGGVKRGRLQQEAAATGSRVTVVLGAQWGDEGKGKVVDLLATDADIISRCQGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVKWVGVGKSRESMIQLF

SEQ ID NO: 28435 - protein, 500 aa, Homo sapiens
MVGRSCGVATQRQGGGQRPTNLALTLSSSPAHSTALPWLPPRSLQLLSGHSVPAQPTPHLPSACGGPTRVTLGEERAWRSHGSNAGGHTCLPRRTAGAGSLTPGGERGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVKWVGVGKSRESMIQLF

SEQ ID NO: 28436 - protein, 364 aa, Homo sapiens [sequence omitted]

SEQ ID NO: 28437 - protein, 853 aa, Homo sapiens
MSEKVDWLQSQNGVCKVDVYSPGDNQAQDWKMDTSTDPVRVLSWLRRDLEKSTAEFQDVRFKPGESFGGETSNSGDPHKGFSVDYYNTTTKGTPERLHFEMTHKEIPCQGPRAQLGNGSSVDEVSFYANRLTNLVIAMARKEINEKIDGSENKCVYQSLYMGNEPTPTKSLSKIASELVNETVSACSRNAAPDKAPGSGDRVSGSSQSPPNLKYKSTLKIKESTKERQGPDDKPPSKKSFFYKEVFESRNGDYAREGGRFFPRERKRFRGQERPDDFTASVSEGIMTYANSVVSDMMVSIMKTLKIQVKDTTIATILLKKVLLKHAKEVVSDLIDSFLRNLHSVTGTLMTDTQFVSAVKRTVFSHGSQKATDIMDAMLRKLYNVMFAKKVPEHVRKAQDKAESYSLISMKGMGDPKNRNVNFAMKSETKLREKMYSEPKSEEETCAKTLGEHIIKEGLTLWHKTQQKECKSLGFQHAAFEAPNTQRKPASDISFEYPEDIGNLSLPPYPPEKPENFMYDSDSWAEDLIVSALLLIQYHLAQGGRRDARSFVEAAGTTNFPANEPPVAPDESCLKSAPIVGDQEQAEKKDLRSVFFNFIRNLLSETIFKRDQSPEPKVPEQPVKEDRKLCERPLASSPPRLYEDDETPGALSGLTKMAVSQIDGHMSGQMVEHLMNSVMKLCVIIAKSCDASLAELGDDKSGDASRLTSAFPDSLYECLPAKGTGSAEAVLQNAYQAIHNEMRGTSGQPPEGCAAPTVIVSNHNLTDTVQNKQLQAVLQWVAASELNVPILYFAGDDEGIQEKLLQLSAAAVDKGCSVGEVLQSVLRYEKERQLNEAVGNVTPLQLLDWLMVNL

SEQ ID NO: 28438 - protein, 854 aa, Homo sapiens
MMAYSDTTMMSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 28439 - protein, 845 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 28440 - protein, 478 aa, Homo sapiens
MACLNPVPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 28441 - protein, 453 aa, Homo sapiens
MACLNPVPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKAFPRRTSFNT

SEQ ID NO: 28442 - protein, 1620 aa, Homo sapiens
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 28443 - protein, 623 aa, Homo sapiens
MEPPQETNRPFSTLDNRSGQVQVLSATPLLQRNPYSSPDIMHIKGSEASSVPYALNQGTTALPKNKNQEGTGHRLLNMLRKTLKESDSEELEITQETPNLVPFGDVVGCLGIHIKNCRHFMPKISLQHYANLFIRISINKAVKCTKMCSLLSKNDEKNTVIKFDEVKYFSVQVPRRYDDKRNNILLELIQYDNREKRAFLLGSVQIHLYEVIQKGCFIEEVQVLHGNIFVCRLEVEFMFSYGNFGYGFSHQLKPLQKITEPSMFMNLAPPPERTDPVTKVITPQTVEYPAFLSPDLNVTVGTPAVQSSNQPSVVRLEKLQQQPRERLEKMKKEYRNLNTWIDKANYLESILMPKLEHKDSEETNIDEASENTKSNQPEEELENIVGVDIPLVNEEAETTANELLDNDSEKGLTIPTLNQSDQDNSTADASKNDESTPSPTEVHSLCTISNQETIKAGRIPPLGERQSESMPDRKMKNVFFPLEVKLKDNYPSILKADSSLSEVAFSPKEYNSPSFRPEYIEFKPKFQDCSDKFEDLHDMTSFTHLKKVKSRSRLLGKSSDDIHNHARHSARPYTAPEVNKQRESYSGKFTSRRMVSSGLVHINDKTSDYEMHKMRPKKIKRGY

SEQ ID NO: 28444 - protein, 445 aa, Homo sapiens
MYPNPLIYCTCWDPWNLGPRKLIKTPQLPRKNSTGSSKLTPLLPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKNRELKEAHEAELSELENNYKAALKAEKLAAQEKLEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVPWRRDQINRHWHDVLQQLLLMQVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 28445 - protein, 823 aa, Homo sapiens
MKLFGFGSRRGQTAQGSIDHVYTGSGYRIRDSELQKIHRAAVKGDAAEVERCLARRSGDLDALDKQHRTALHLACASGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKRKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNRDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTRDVSVQVEMSSAISKVKDENEFLTEQLSETQIKFNALKDKFRKTRDSLRKKSLALETVQNDLSQTQQQTQEMKEMYQNAEAKVNNSTGKWNCVEERICHLQRENAWLVQQLDDVHQKEDHKEIVTNIQRGFIESGKKDLVLEEKSKKLMNECDHLKESLFQYEREKTEGVVSIKEDKYFQTSRKKI

SEQ ID NO: 28446 - protein, 823 aa, Homo sapiens
MKLFGFGSRRGQTAQGSIDHVYTGSGYRIRDSELQKIHRAAVKGDAAEVERCLARRSGDLDALDKQHRTALHLACASGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKRKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNRDFHNHEEMKGLMDENCILKADIAILRQEICTMKNDNLEKENKYLKDIKIVKETNAALEKYIKLNEEMITETAFRYQQELNYLKAENTRLNAELLKEKESKKRLEADIESYQSRLAAAISKHSESVKTERNLKLALERTRDVSVQVEMSSAISKVKDENEFLTEQLSETQIKFNALKDKFRKTRDSLRKKSLALETVQNDLSQTQQQTQEMKEMYQNAEAKVNNSTGKWNCVEERICHLQRENAWLVQQLDDVHQKEDHKEIVTNIQRGFIESGKKDLVLEEKSKKLMNECDHLKESLFQYEREKTEGVVSIKEDKYFQTSRKTI

SEQ ID NO: 28447 - protein, 1053 aa, Homo sapiens
MAFLKLRDQPSLVQAIFNGDPDEVRALIFKKEDVNFQDNEKRTPLHAAAYLGDAEIIELLILSGARVNAKDSKWLTPLHRAVASCSEEAVQVLLKHSADVNARDKNWQTPLHIAAANKAVKCAEALVPLLSNVNVSDRAGRTALHHAAFSGHGEMVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGYTPALACAPNKDVADCLALILATMMPVSSSSPLSSLTFNAINRYTNTSKTVSFEALPIMRNEPSSYCSFNNIGGEQEYLYTDVDELNDSDSETY

SEQ ID NO: 28448 - protein, 389 aa, Homo sapiens
MPGVANSGPSTSSRETANPCSRKKVHFGSIHDAVRAGDVKQLSEIVCLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCGIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARRPSKNCRASWSMNDYVEKN

SEQ ID NO: 28449 - protein, 776 aa, Homo sapiens
MALADKRLENLQIYKVLQCVRNKDKKQIEKLTKLGYPELINYTEPINGLSALHLASVSNDIDMVSFLLDLGAHPDVQDRMGCTPTMRAAELGHELSMEILAKAKADMTIVDNEGKGVLFYCILPTKRHYRCALIALEHGADVNNSTYEGKPIFLRACEDAHDVKDVCLTFLEKGANPNAINSSTGRTALMEASREGVVEIVRGILERGGEVNAFDNDRHHAAHFAAKGGFFDILKLLFAYNGDVGLISINGNTPLHYAAMGGFADCCKYIAQRGCDLKWKNLDHKTPRAVAKEGGFKAASKEIRRAERIANKLARPGAKNPNPLWALRLHDWSVEREAFLREAFAVLDRGDGSISKNDFVMVLEERQDYASSEQLAAIAHLHEKTRGGGVNINEFFKGTRYLNKSFVLGSYGPKKKEKGMGKKGKKGKFVLPLPICVIPEYAFPRRQDGGPPYYMIETYKNVTDSSRFNRDHPPEHPIQDDSVWYIDDSEKVFSNINIITKAGDLASLKKAFESGIPVDMKDNYYKTPLMTACASGNIDVVKFLLEKGANVNATDNFLWTPLHFACHAGQQDIVELLVESGALIDAASINNSTPLNRAIESCRLDTVKYLLDIGAKFQLENRKGHSAMDVAKAYADYRIIDLIKEKLDNLPKPAENQKLKGKTPPILKTEGPEIKKEEELLSSIYGVPTTSEGKKVQKGNVVHLNSLITSGYTKKVDITFIPRRIWSPEATTAELIRKRELRRERFTHEVDFDDFMMPFQKNITEKARALEAALKT

SEQ ID NO: 28450 - protein, 776 aa, Homo sapiens; identical to SEQ ID NO: 28449

SEQ ID NO: 28451 - protein, 414 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 28452 - protein, 1248 aa, Homo sapiens
MGKDQELLEAARTGNVALVEKLLSGRKGGILGGGSGPLPLSNLLSIWRGPNVNCTDSSGYTALHHAALNGHKDIVLKLLQYEASTNVADNKGYFPIHLAAWKGDVEIVKILIHHGPSHSRVNEQNNENETALHCAAQYGHSEVVAVLLEELTDPTIRNSKLETPLDLAALYGRLRVVKMIISAHPNLMSCNTRKHTPLHLAARNGHKAVVQVLLEAGMDVSCQTEKGSALHEAALFGKVDVVRVLLETGIDANIKDSLGRTVLDILKEHPSQKSLQIATLLQEYLEGVGRSTVLEEPVQEDATQETHISSPVESPSQKTKSETVTGELSKLLDEIKLCQEKDYSFEDLCHTISDHYLDNLSKISEEELGKNGSQSVRTSSTINLSPGEVEEEDDDENTCGPSGLWEALTPCNGCRNLGFPMLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGETTRPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 28453 - protein, 321 aa, Homo sapiens
MAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 28454 - protein, 367 aa, Homo sapiens
MEPIYEEYLANHGTIVKPYYWLSFSLDCSNCPYHIRTGEEARVSLTEFCQIFGFPYGTTFPQTKHLTFYELKTSSGSLVQKGHASSCTGNYIHPESMLFEMNGYLDSAIYNNDSIRHIILYSNNSPCNEANHCCISKMYNFLITYPGITLSIYFSQLYHTEMDFPASAWNREALRSLASLWPRVVLSPISGGIWHSVLHSFISGVSGSHVFQPILTGRALADRHNAYEINAITGVKPYFTDVLLQTKRNPNTKAQEALESYPLNNAFPGQFFQMPSGQLQPNLPPDLRAPVVFVLVPLRDLPPMHMGQNPNKPRNIVRHLNMPQMSFQETKDLGRLPTGRSVEIVEITEQFASSKEADEKKKKKGKK

SEQ ID NO: 28455 - protein, 570 aa, Homo sapiens
MRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENSHGSSECIKIQNQRLYEIGGNIGEHCLDPDAYILDVYRINPQAEWVIKPQQSS

SEQ ID NO: 28456 - protein, 297 aa, Homo sapiens
MFRLLSSCCSCLRTTEETRRNVTIPIIGLNNSGKTVLVEAFQKLLPSKTDHCMKSELTTLLLDEYELSIYDLNGDLKGREAWPNYYAQAHGLVFVLDSSDIRRMQEVKIILTHLLSDKRVAGKPILILANKQDKKKALMPCDIIDYLLLKKLVKENKCPCRVEPCSAIRNLERRNHQPIVEGLRWLLAVIDTCQLPPTSSISISKNNTGSGERCSSHSFSTRTGMSKEKRQHLEQCSIEAKPLKSILQILAIKSILYSLRGSRRVRWHPLRMKTTLVKKNRDFTSLYRDAADKACGQ

SEQ ID NO: 28457 - protein, 163 aa, Homo sapiens
MDALEGESFALSFSSASDAEFDAVVGYLEDIIMDDEFQLLQRNFMDKYYLEFEDTEENKLIYTPIFNEYISLVEKYIEEQLLQRIPEFNMAAFTTTLQHHKDEVAGDIFDMLLTFTDFLAFKEMFLDYRAEKEGRGLDLSSGLVVTSLCKSSSLPASQNNLRH

SEQ ID NO: 28458 - protein, 860 aa, Homo sapiens
MLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINEDIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 28459 - protein, 872 aa, Homo sapiens
MGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPVIQLLALKTLGVIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGQSISSSSSLRRSSKEKNKKNSYHFSAGFGSPIEDKSEPASGRNTVLSKSATKEKGWRKSKGKKEEEKVKEEEEVMVVPKFVGEGSSDKEWCPPSDPDFSMYVYEVTKSILPITNIKEQIEDLAKYVAEKMGGKIPKEKLPDFSWELHISELKFQLKSNVIPIGHVKKGIFYHRALLFKALADRIGIGCSLVRGEYGRAWNEVMLQNDSRKGVIGGLPAPEMYVIDLMFHPGGLMKLRSREADLYRFI

SEQ ID NO: 28460 - protein, 372 aa, Homo sapiens
MNHCQLPVVIDNGSGMIKAGVAGCREPQFIYPNIIGRAKGQSRAAQGGLELCVGDQAQDWRSSLFISYPVERGLITSWEDMEIMWKHIYDYNLKLKPCDGPVLITEPALNPLANRQQITEMFFEHLGVPAFYMSIQAVLALFAAGFTTGLVLNSGAGVTQSVPIFEGYCLPHGVQQLDLAGLDLTNYLMVLMKNHGIMLLSASDRKIVEDIKESFCYVAMNYEEEMAKKPDCLEKVYQLPDGKVIQLHDQLFSCPEALFSPCHMNLEAPGIDKICFSSIMKRDTGLRNSFFSNIILAGGSTSFPGLDKRLVKDIAKVAPANTAVQVIAPPERKISVWMGGSILASLSAFQDMWITAAEFKEVGPNIVHQRCF

SEQ ID NO: 28461 - protein, 378 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPEDKSQGNINNPTPGPVPVPGPKSHPSASSGKLLLPQFGMVIILISVSAINLFVAL

SEQ ID NO: 28462 - protein, 295 aa, Homo sapiens
MSKSTKLCGKTSCPRSNIFCNLLDKIVKRPSLQFLGQWGYHCYEPRIYRSLAKILRYVDLDGFDALLTDYIAFVEKSGYRFEVSFNLDFTEICVNTILYWVFARKGNPDFVELLLKKTKDYVQDRSCNLALIWRTFTPVYCPSPLSGITPLFYVAQTRQSNIFKILLQYGILEREKNPINIVLTIVLYPSRVRVMVDRELADIHEDAKTCLVLCSRVLSVISVKEIKTQLSLGRHPIISNWFDYIPSTRYKDPCELLHLCRLTIRNQLLTNNMLPDGIFSLLIPARLQNYLNLEI

SEQ ID NO: 28463 - protein, 187 aa, Homo sapiens
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKIDILLKAVGDTPIMKTKKWAVERTRTIQGLIDFIKKFLKLVASEQLFIYVNQSFAPSPDQEVGTLYECFGSDGKLVLHYCKSQAWG

SEQ ID NO: 28464 - protein, 165 aa, Homo sapiens
MIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 28465 - protein, 1029 aa, Homo sapiens
MGLWGKKGTVAPHDQSPRRRPKKGLIKKKMVKREKQKRNMEELKKEVVMDDHKLTLEELSTKYSVDLTKGHSHQRAKEILTRDGPNTVTPPPTTPEWVKFCKQLFGGFSLLLWTGAILCFVAYSIQIYFNEEPTKDNLYLSIVLSVVVIVTGCFSYYQEAKSSKIMESFKNMVPQQALVIRGGEKMQINVQEVVLGDLVEIKGGDRVPADLRLISAQGCKVDNSSLTGESEPQSRSPDFTHENPLETRNICFFSTNCVEGTARGIVIATGDSTVMGRIASLTSGLAVGQTPIAAEIEHFIHLITVVAVFLGVTFFALSLLLGYGWLEAIIFLIGIIVANVPEGLLATVTVCLTLTAKRMARKNCLVKNLEAVETLGSTSTICSDKTGTLTQNRMTVAHMWFDMTVYEADTTEEQTGKTFTKSSDTWFMLARIAGLCNRADFKANQEILPIAKRATTGDASESALLKFIEQSYSSVAEMREKNPKVAEIPFNSTNKYQMSIHLREDSSQTHVLMMKGAPERILEFCSTFLLNGQEYSMNDEMKEAFQNAYLELGGLGERVLGFCFLNLPSSFSKGFPFNTDEINFPMDNLCFVGLISMIDPPRAAVPDAVSKCRSAGIKVIMVTGDHPITAKAIAKGVGIISEGTETAEEVAARLKIPISKVDASAAKAIVVHGAELKDIQSKQLDQILQNHPEIVFARTSPQQKLIIVEGCQRLGAVVAVTGDGVNDSPALKKADIGIAMGISGSDVSKQAADMILLDDNFASIVTGVEEGRLIFDNLKKSIMYTLTSNIPEITPFLMFIILGIPLPLGTITILCIDLGTDMVPAISLAYESAESDIMKRLPRNPKTDNLVNHRLIGMAYGQIGMIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 28466 - protein, 888 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILGLALGEEWTAAG

SEQ ID NO: 28467 - protein, 949 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEVWLWERSGQQLVEIHPHLETGLPLTEDVSCV

SEQ ID NO: 28468 - protein, 939 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 28469 - protein, 919 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 28470 - protein, 309 aa, Homo sapiens
MSSPRAVVQLGKAQPAGEELATANQTAQQPSSPAMRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 28471 - protein, 290 aa, Homo sapiens
MATANQTAQQPSSPAMRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 28472 - protein, 275 aa, Homo sapiens
MRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 28473 - protein, 998 aa, Homo sapiens [sequence omitted]

SEQ ID NO: 28474 - protein, 736 aa, Homo sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCPKYRKFQKAFGTDRVRTGESSVKDIHASVQPNERSENECLGGVPECRDLQVMLKCDESKLAMEPEETKKDPASQCPTEKSEVTPFPHNSSIDPHGLYSLSLLHTYDQYGDLNFAGMQNTTVLTEKPLSGTDVQEKTFGESQDLPLKSDLGTREDSSVASSDRSSVEREVAEHLAKGFWSDICSTDTPCQMQLSPAVAKDGSEQISQKRSECPWLGIRISESPEPGQRTFTTLSSVNCPFISTLSTEGCSSNLEIGNDDYVSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLQSEKESLLKERDHILSTLGETKQNLTGLCQKVCKEAALSQEQIQILAKYSAADCPLSFLISEKDKSTPDGELALPSIFSLSDRPPAVLPPCARGNSEPGYARGQESQQMSTATSEQAGPAEQCRQSGGISDFCQQMTDKCTTDE

SEQ ID NO: 28475 - protein, 736 aa, Homo sapiens; identical to SEQ ID NO: 28474

SEQ ID NO: 28476 - protein, 447 aa, Homo sapiens
MDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 28477 - protein, 488 aa, Homo sapiens
MRFHWLPTLSEPFDRNQELETCIRPLWTPSGSACETEHNKSMDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 28478 - protein, 447 aa, Homo sapiens; identical to SEQ ID NO: 28476

SEQ ID NO: 28479 - protein, 341 aa, Homo sapiens
MSVLDALWEDRDVRFDLSAQQMKTRPGEVLIDCLDSIEDTKGNNGDRGRLLVTNLRILWHSLALSRVNVSVGYNCILNITTRTANSKLRGQTEALYILTKCNSTRFEFIFTNLVPGSPRLFTSVMAVHRAYETSKMYRDFKLRSALIQNKQLRLLPQEHVYDKINGVWNLSSDQGNLGTFFITNVRIVWHANMNDSFNVSIPYLQIRSIKIRDSKFGLALVIESSQQSGGYVLGFKIDPVEKLQESVKEINSLHKVYSASPIFGVDYEMEEKPQPLEALTVEQIQDDVEIDSDGHTDAFVAYFADGNKQQDREPVFSEELGLAIEKLKDGFTLQGLWEVMS

SEQ ID NO: 28480 - protein, 445 aa, Homo sapiens
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 28481 - protein, 1271 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKNDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 28482 - protein, 125 aa, Homo sapiens
MLSRLLKEHQAKQNERKELQEKRRREAITAATCLTEALVDHLNVGVAQAYMNQRKLDHEVKTLQVQAAQFAKQTGQWIGMVENFNQALKEIGDVENWARSIELDMRTIATALEYVYKGQLQSAPS

SEQ ID NO: 28483 - protein, 283 aa, Homo sapiens
MQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 28484 - protein, 295 aa, Homo sapiens
METESGPQTSNQMQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 28485 - protein, 947 aa, Homo sapiens
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECILPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 28486 - protein, 947 aa, Homo sapiens; identical to SEQ ID NO: 28485

SEQ ID NO: 28487 - protein, 360 aa, Homo sapiens
MNYTESSPLRESTAIGFTPELESIIPVPSNKTTCENWREIHHLVFHVANICFAVGLVIPTTLHLHMIFLRGMLTLGCTLYIVWATLYRCALDIMIWNSVFLGVNILHLSYLLYKKRPVKIEKELSGMYRRLFEPLRVPPDLFRRLTGQFCMIQTLKKGQTYAAEDKTSVDDRLSILLKGKMKVSYRGHFLHNIYPCAFIDSPEFRSTQMHKGEKFQVTIIADDNCRFLCWSRERLTYFLESEPFLYEIFRYLIGKDITNKLYSLNDPTLNDKKAKKLEHQLSLCTQISMLEMRNSIASSSDSDDGLHQFLRGTSSMSSLHVSSPHQRASAKMKPIEEGAEDDDDVFEPASPNTLKVHQLP

SEQ ID NO: 28488 - protein, 360 aa, Homo sapiens; identical to SEQ ID NO: 28487

SEQ ID NO: 28489 - protein, 335 aa, Homo sapiens
MIREWKNDCQRIEKQRASDTMVQERKNEKPVRIFNTNSSFQDQAPTCCQEDLSSASPLRIWSKFYRSDPRIALGKYSPLEKEILRLGGIHTIAARRLLAYKQEEECRMLKELQLLSPDYKQAMEYKKKHSSPCAICVPLEKIWTAKVIAPLEAFKMPQREQVNVSKHIERMRLARALGNHQPLPYIERFTRSSFLSGVGLGPMAKNKARRKEDNYDTHNCDDANQDKKEEAEGKNTKRREIKMNVVFKSKEPKKCLTYHGNDRKSFLPAKKPERSIAGLTNRNLFCISEFPGDLMLMNQDFISRRDHFSDLVKTYSLEEESIWKERMRKATPYHY

SEQ ID NO: 28490 - protein, 129 aa, Homo sapiens
MTKGRRFNPPSDKDGRWFPHIGLTQKTPESITSATSKEPQSPHLPRQAEGKLPPIYKVREKQAVNNQFPFSVHDNRHSLENSGCYLDSERMTATDPQGEPDKRQEFYEPVRTQSIPHPGLRTNAPLLAV

SEQ ID NO: 28491 - protein, 186 aa, Homo sapiens
MTKGRRFNPPSDKDGRWFPHIGLTQKTPESITSATSKEPQSPHLPRQAEGKLPPIYKVREKQAVNNQFPFSVHDNRHSLENSGCYLDSGLGRKKISPDKRQHVSRNFNLWACDYVPSCLDGFSNNQISYVYKEAMVVSSFRRFPRCYKEIWNAFTFLPERSYTEVLKKKPKVRFTVDKKVVSSLES

SEQ ID NO: 28492 - protein, 186 aa, Homo sapiens; identical to SEQ ID NO: 28491

SEQ ID NO: 28493 - protein, 105 aa, Homo sapiens
MATGTPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 28494 - protein, 223 aa, Homo sapiens
MLWVQRKRRRKETSECPSDKDKSPESHKAKNESWIKSHFSRLSEEKLALDNNASASGNATQTESGSEEVSSTVHIETFTTRHGEVGSALHRESFTSRQKTSGPSVIQEIHQESGKAPSTDDATWAAVAACTKEIDTQGRHLAHSMLQRAIAYQHSGHLESKDINQEELRALEEVEMKLQKNFLTQRENTIAGANHTHTFYGHSHHSHHGHPSHQSHSLPNRRH

SEQ ID NO: 28495 - protein, 628 aa, Homo sapiens
MTEEQTYQAAEKSQAHNEVPNERLVVEHQESLSKTKLQVKKQETSTEQPLTTPDKEPNENLILRHQDSMSKSEMQVKEQRTLKGQRIITHDEEPGKNLVPEHQDSVSKLEMQIEKTKKLPREKRHSTHDEESGENPMLKHQDSVSKIQVQLEIQETSEGEGRSIPDKNSMFVHQDSVSKLQMQEKKKITPGRERRNTRIVVPNESVISVHQDSKSKLQMQEKKQINSGVERHKTFPLEIKKKDISLEHLLPEEKVLLSRSESQTKKLQAKVTSRKKTDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHAETDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTIGKPTYKVLHAAARKSVPHPYF

SEQ ID NO: 28496 - protein, 872 aa, Homo sapiens
MAEEKGGKQVLEESAFEEMERDFQGVLHELSGDKSLEKFRIEYERLHAVMKKSYDNEKRLMAKCRELNAEIVVNSAKVATALKLSQDDQTTIASLKKEIEKAWKMVDSAYDKEQKAKETILALKEEIVNLTKLVEQGSGLSMDQHSNIRDLLRFKEEVTKERDQLLSEVVKLRESLAQTTEQQQETERSKEEAEHAISQFQQEIQQRQNEASREFRKKEKLEKELKQIQADMDSRQTEIKALQQYVQKSKEELQKLEQQLKEQKILNERAAKELEQFQMRNAKLQQENEQHSLVCEQLSQENQQKALELKAKEEEVHQMRLDIGKLNKIREQIHKKLHHTEDQKAEVEQHKETLKNQIVGLEREVEASKKQAELDRKAMDELLRERDILNKNMLKAVNATQKQTDLVKLHEQAKRNLEGEIQNYKDEAQKQRKIIFHLEKERDRYINQASDLTQKVLMNMEDIKVRETQIFDYRKKIAESEIKLKQQQNLYEAVRSDRNLYSKNLVEAQDEITDMKRKLKIMIHQVDELKEDISAKESALVKLHLEQQRIEKEKETLKAELQKLRQQALETKHFIEKQEAEERKLLRIIAEADGERLRQKKELDQVISERDILGSQLVRRNDELALLYEKIKIQQSVLNKGESQYNQRLEDMRILRLEIKKLRREKGILARSMANVEELRQEFFHMQRELLKERTRCRALEEELENPLNVHRWRKLEASDPNAYELIQKIHTLQKRLISKTEEVVEKELLLQEKEKLYMELKHVLARQPGPEAAEQLKLYRRTLHDKKQQLKVLSSELNMYEVQSKEYKYEVEKLTNELQNLKKKYLAQKRKEQLQKNKDTAPMDNTFLMVKPNGPGFTGGGFPLRSTKMTF

SEQ ID NO: 28497 - protein, 233 aa, Homo sapiens
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEKSGLEKRIDQAVEEWNIEKAEELSNQLATRELGVKIAKAVACHNFVKAKKEVENSQAARKKKKLAWGFEAKKRWETKSNMGYM

SEQ ID NO: 28498 - protein, 634 aa, Homo sapiens
MRWLRPAGRRREQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSFVQVIGHPPRDHRASSEQALVQAGSYSRDSEDLQKTHSPRHGEPVLSPQPCTDPDHWSPELLQSPTGLKIVAVSCREKFVRIFNPSQESTADLSGMVLKQLVRGFPERLYRFPPGTLLAPRHHVTVWGEATRSAKKPLRASSSREPVPLLSIRGCATLLLSPKGEVLSEHRIPRRETPAPRVFADGTDLSIDRFPLPEAGPGADTRKPPRPPRPLRKGRVREPRVSRRRPGTRGLLPPVSSGKLFHAREGPARPENPEIPAPQHLPAIPGDPTLPSPPAEAGLGLEDCRLQKEHRVRVCRKSVDRSCPLVALSVQNTAESRFGFRFLSCLPVTADTCRGA

SEQ ID NO: 28499 - protein, 158 aa, Homo sapiens
MDLASEITSATQTSSLCSSGRGHAGYPAPGIVAHGFETHGTARVAQGHLLPPCLLPPPQMPVLAALRDLSRRGSTSSSRSPSRPVSTSASKPCLPASCLGETWSISINLVGSSGHLQSPGAQRDAQRETGCLGPFWLPHHQVRDEELSLSHSAQGEEF

SEQ ID NO: 28500 - protein, 333 aa, Homo sapiens
MLVGTPNLLTLDEADATWTLIKDKVIEEHFGPNAVAVPFLSDAACYDLLGVLVKQSRPAHTRLALPGRQGRRALKPVGPLPSLLEQAGSEGAFAHCTREYSPNGRAERAYEETRMLDGQPCKIRLHMGDLRKKVAFLLLPPGQVSLQQTLPWLRSTHSIYVIYQVFSCSWLQLGLTSTAREPQLLRLLRSLPVAFSCLKFSLQSKGVLGPQKPLTKDPLPHGANWVRPNLSIMPPLAPTSASADTTEAADVPPPVPAPPTPPPQEGPEDKPTRFSYKGRNPFWRGPQILSENWLFSPRSPPPGAQGGGPRDPDGHSMSLPLLQGLSSEFDSDD

SEQ ID NO: 28501 - protein, 414 aa, Homo sapiens
MEMQQNCSISCFWETQPLGCVKISCIFYHSKPRNINGLFLPPSSNITLQKEIQEGIPLQSQSQEPLKPQENISRPIHHPLVLKTNFEEEEEVDEQNDASSLWTKTPEEIEEKRAIKEMCYKSGEYYRFHTPPDILSSKSMTPTAEKQLEKPLENGSELQEGDSLTVPTKLSQYERQGEIKTSLHGKPKTDIAAFENGGGDCYVPQRVIFLGVDESEALTEEKEITISKCSNTKDNKDSPHPKHSLTTRLVPTTHVLNATENISMKCREDPSSMNDVQPVKKPHFKGVKKRKWIYDEPQNFPNSGMQRAVQAPRPQNKMSYHRNNKNRNAENASYIHVQRDAVRTVALNAPSRSRPTHGSYNKVHANREPKPNLSPDKYTSTSYNDSAWRKRIPFSKTYSKSEKIYPEPRRNGSK

SEQ ID NO: 28502 - protein, 909 aa, Homo sapiens
MLSVAVKILSDKSESNTKEFLIAVGLKGATLQHRMLPSGLSWHEQILYFLNIADEPVLGYNPPTSFTTFHVHLWSCALDYRPLYLPIRSLLTVETFSVSSSVALDKSSSTLRIILDEAALHLSDKCNTVTINLSRDYVRVMDMGLLELTITAVKSDSDGEQTEPRFELHCSSDVVHIRTCSDSCAALMNLIQYIASYGDLQTPNKADMKPGAFERRSKVDSSGRSSSRGPVLPEADQQMLRDLMSDAMEEIDMQQGTSSVKPQANGVLDEKSQIQEPCCSDLFLFPDESGNVSQESGPTYASFSHHFISDAMTGVPTENDDFCILFAPKAAMQEKEEEPVIKIMVDDAIVIRDNYFSLPVNKTDTSKAPLHFPIPVIRYVVKEVSLVWHLYGGKDFGTVPPTSPAKSYISPHSSPSHTPTRHGRNTVCGGKGRNHDFLMEIQLSKVKFQHEVYPPCKPDCDSSLSEHPVSRQVFIVQDLEIRDRLATSQMNKFLYLYCSKEMPRKAHSNMLTVKALHVCPESGRSPQECCLRVSLMPLRLNIDQDALFFLKDFFTSLSAEVELQMTPDPEVKKSPGADVTCSLPRHLSTSKEPNLVISFSGPKQPSQNDSANSVEVVNGMEEKNFSAEEASFRDQPVFFREFRFTSEVPIRLDYHGKHVSMDQGTLAGILIGLAQLNCSELKLKRLSYRHGLLGVDKLFSYAITEWLNDIKKNQLPGILGGVGPMHSLVQLVQGLKDLVWLPIEQYRKDGRIVRGFQRGAASSGTSTAMAALELTNRMVQTIQAAAETAYDMVSPGTLSIEPKKTKRFPHHRLAHQPVDLREGVAKAYSVVKEGITDTAQTIYETAAREHESRGVTGAVGEVLRQIPPAVVKPLIVATEATSNVLGGMRNQIRPDVRQDESQKWRHGDD

SEQ ID NO: 28503 - protein, 139 aa, Homo sapiens
METDCNPMELSSMSGFEEGSELNGFEGTDMKDMRLEAEAVVNDVLFAVNNMFVSKSLRCADDVAYINVETKERNRYCLELTEAGLKVVGYAFDQVDDHLQTPYHETVYSLLDTLSPAYREAFGNALLQRLEALKRDGQS

SEQ ID NO: 28504 - protein, 237 aa, Homo sapiens
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGS

SEQ ID NO: 28505 - protein, 219 aa, Homo sapiens
MGVVPVSYFIRNMEESYVNLNHHGLGPRGTKAIAIALVSNMAVTKLELEDNCIMEEGVLSLVEMLQENYYLQEMNISNNHLGLEGARIISDFFERNSSSIWSLELSGNDFKEDSAALLCQALSTNYQIKKLDLSHNQFSDVGGEHLGQMLAINVGLTSLDLSWNNFHTRGAVALCNGLRGKSSDSTAAWSTWISVAMTSAMKGPPKSAKDWNPMKASEF

SEQ ID NO: 28506 - protein, 674 aa, Homo sapiens
MAEVPEDYDSGPDEDGELEPERPELPGLHKLYENAEPDTMAKADSKLPAEIYQEPQPETEEEDFKEGEPDSAKNVQLKPGGTSQEGIAKESKRDVPSETEPGIHQEVKSETSREMGEFFKDLEAPMDETHKESDLEPPEEAKPNVTEDVFLESAMETDPDPVPPTETMSEVSGATVRERNLELLEEETEPGVPEESLRVQHEETGLEPPEQTKQDFPSEKLGESLEETDLQPPKMTKPETPEETQRESTEKKRTEPPEQARLEFLEKEPRKSSEEAGLEPPEETQPEVPEEMQRKATEEKGTELPERTKPDFPDHKPRKSTDENVPEPLEEIKLEFPEEESRKTNEETILEQSEMMKPESPEEIRKSNEKKNPQPPEETGPVLPQEINPQVEEKTQTKPTEKILELPDETKPRETHVEFSKEDRPEPIKSKYSVGNDELEHREPKRGKLSLSDKFRKEYYALGSLRESEESIGTHYEFLQPLQKLLNVSEECSYSDPSESQTELSEFVHEKEVVDLSQELKERVSEDDETQPEKGTELQFEHLNWDPEEVAEWISQLGFPQYKECFITNFISGRKLIHVNCSNLPQMGITNFEDMKAISRHTQELLEIEEPLFKRSISLPYRDIIGLYLEQKGHTGIKSDSLTLSEFVKAAGLQDYAPEITAPEENEELPCTEP

SEQ ID NO: 28507 - protein, 422 aa, Homo sapiens
MKKNTSKTTMRINKQDALCTPHSHDPRDLQNMLDGGEYAPFVSPPMLESNFIQVNRRGESIYLHNRANWVTVGICFSSSTHKIPNVMLLAHPTPGAQKDTETLFKSLLTSPPAEKLVLTRFLPLQFVTLSVHDAENMSLKVKLVSGRAYYLQLCTSAYKQDTLFSQWVALISLLNQEKAKVSKVSEVSSLSGITNSTDITGSMDVTDVTTFTAILTPYMYAGTGPEHVRDSIDFPEFTDITDITDVTDLPENEVPEVPDVRIVTEVIEVREATEVTDSSDITNCSGVTVVFENNDLIRAKQEEKEKLKNILKPGCLQDTKSKSELKESSKHVTISNITLTFEGKRYFQTTLTPVESEANTSKEMKDKTSEEKMPDFQSTALKAEESRSLRTESNTSVLSPHIKSPSNFLKLVPHLSAPFSRE

SEQ ID NO: 28508 - protein, 170 aa, Homo sapiens
MASEAEKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATKATTVGAVDRLTDTSKYTGTHKELFDESGKGKGIAGREEMTDNTGYVSGYKGSGTYDKKTK

SEQ ID NO: 28509 - protein, 139 aa, Homo sapiens
MVTHAAGARTFCEEQKKGSTYSVPKSKEKLMEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 28510 - protein, 300 aa, Homo sapiens
MCARGQVGRGTQLRTGRPCSQVPGSRWRPERLLRRQRAGGRPSRPHPARARPGLSLPATLLGSRAAAAVPLPLPPALAPGDPAMPVRTECPPPAGASAASAASLIPPPPINTQQPGVATSLLYSGSKFRGHQKSKGNSYDVEVVLQHVDTGNSYLCGYLKIKGLTEEYPTLTTFFEGEIISKKHPFLTRKWDADEDVDRKHWGKFLAFYQYAKSFNSDDFDYEELKNGDYVFMRWKEQFLVPDHTIKDISGASFAGFYYICFQKSAASIEGYYYHRSSEWYQSLNLTHVPEHSAPIYEFR

SEQ ID NO: 28511 - protein, 126 aa, Homo sapiens
MLWRFISLFSELEAKQLRRLYKYTKSSQPAKFLVTFCASDAPERSLLADREDSLPKLCHAWGLHSNISGMKERLSNMQTPGQGSPLPGQPRSQDHVKKDSLRELSQKPKLKRKRIKEAPETPETEP

SEQ ID NO: 28512 - protein, 609 aa, Homo sapiens
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHNCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKKLCRPLPWKSTVPPCIGVAKTTGDCRSKTCLD

SEQ ID NO: 28513 - protein, 86 aa, Homo sapiens
MVRHPYSVQTQLSTEAKAIWRSMQQQETNLLANLTTNDARDNSKDFQNSKVGAAATSRDEGCNCPIIGEIVISCYWLFEIPPLISE

SEQ ID NO: 28514 - protein, 372 aa, Homo sapiens
MAKSKTKHRLCSQESSVSALLASCTLSGSNSSNSDGSFHYKDKLYRSASQALQAYIDDFDLGQIYPGASTGKINIDEDFTNMSQFCNYIYKPNNAFENLDHEKHSNFISCRRHIVNDIDSMSLTTDDLLRLPADGSFSYTYVGPSHRTSKKNKKCRGRLGSLDIEKNPHFQGPYTSMGKDNFVTPVIRSNINGKQCGDKIELLILKAKRNLEQCTEELPKSMKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 28515 - protein, 799 aa, Homo sapiens
MALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFRGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 28516 - protein, 389 aa, Homo sapiens
MSVRTLPLLFLNLGGEMLYILDQRLRAQNIPGDKARKDEWTEVDRKRVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEQAALTRPEELSYEVINIQATQDQQRSEELARIMGEFEITEQPRLSTSKGDDLLAMMDEL

SEQ ID NO: 28517 - protein, 223 aa, Homo sapiens
MSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRRECFWKHMQETVHSAQCCLPGVGNYMEDRRRRLTFHYVYPFENFEFCTWAK

SEQ ID NO: 28518 - protein, 192 aa, Homo sapiens
MACGATLKRPMEFEAALLSPGSPKRRRCAPLPGPTPGLRPPDAEPPPPFQTQTPPQSLQQPAPPGSERRLPTPEQIFQNIKQEYSRYQRWRHLEVVLNQSEACASESQPHSSALTAPSSPGSSWMKKDQPTFTLRQVGIICERLLKDYEDKIREEYEQILNTKLAEQYESFVKFTHDQIMRRYGTRPTSYVS

SEQ ID NO: 28519 - protein, 725 aa, Homo sapiens
  VARIANT 271: Xaa = Any Amino Acid
MRPQDPALYPQAPHPLALGRASHPSQSRNTPPAGRPRAAARCGPERRAPIGQSGRGREKWPTAASALGLLRRWRRASKASVPADSFRTISPDRRGEKSASAVSGDTAAATTLKGTAIPVRSVVASPRPVKGKAGRETARLRLQRLPAAQAEDTGEAAAAAAEEPLLPVPEDEEEAQPLPPVCVSRMRGMWRDEKVSLYCDEVLQDCKAEDADEVMGKYLSEKLKLKDKWLGVWKTNPSVFFVKYEEASIPFVGILVEVTCEPYQDSSSRLXVTVSVAEPFSSNIANIPRDLVDEILEELEHSVPLLEVYPVEGQDTDIHVIALALEVVRFFYDFLWRDWDDEESCENYTALIEERINLWCDIQDGTIPGPIAQRFKKTLEKYKNKRVELIEYQSNIKEDPSAAEAVECWKKYYEIVMLCGLLKMWEDLRLRVHGPFFPRILRRRKGKREFGKTITHIVAKMMTTEMIKDLSSDTLLQQHGDLDLALDNCYSGDTVIIFPGEYQAANLALLTDDIIIKGVGKREEIMITSEPSRDSFVVSKADNVKLMHLSLIQQGTVDGIVVVESGHMTLENCILKCEGTGVCVLTGAALTITDSEITGAQGAGVELYPGSIAILERNEIHHCNNLRTSNSSKSTLGGVNMKVLPAPKLKMTNNHIYSNKGYGVSILQPMEQFFIVAEEALNKRASSGDKKDDKMLFKVMQNLNLEMNNNKIEANVKGDIRIVTS

SEQ ID NO: 28520 - protein, 1320 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVEMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREDVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 28521 - protein, 125 aa, Homo sapiens
MERHTSHPNRKVPAKEEANAVPLCRAKPSPSYINLQASSPPATFLNIQTTKLPSVDHKPKECLGLLECMYANLQLQTQLAQQQMAVLEHLQASVTQLAPGRGSNNSSLPALSPNPLLNHLPQFSK

SEQ ID NO: 28522 - protein, 454 aa, Homo sapiens
MGRTYIVEETVGQYLSNINLQGKAFVSGLLIGQCSSQKDYVILATRTPPKEEQSENLKHPKAKLDNLDEEWATEHACQVSRMLPGGLLVLGVFIITTLELANDFQNALRRLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQKKSSRGNTQATSHSFDVRVLTQLLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 28523 - protein, 233 aa, Homo sapiens
MSAKRAELKKTHLCKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRGNIPSEASGLYKGGEEPVTTQPSVGHAVPAPKSQTEGR

SEQ ID NO: 28524 - protein, 415 aa, Homo sapiens
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPGLTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKL

SEQ ID NO: 28525 - protein, 623 aa, Homo sapiens
MAGFSHFSQPPYRDLWEPPRPGGERESTQRLGGQRSGADSTACSRAGTPGAESEAGACWLHPHCSFTPRPRRRGCSDSLRGSRSLSDVARRPLERSRKHRPRSRRLEDAWGETGTKPRPAWQPQTQLPPQRPQPCPHYPLAQGDSPPPCPGGAGTPLSGTFRVEKAQGGDQWAVPLGRHLGRWSPSSVPSERSSVPSQKFKRHSACVCAQKRDSSDQVESLASRDSQPLASSKEMRSPHTQVLKSKLEEVVVSSQDQQIVALVLTRLKKAQRIRELQQQAAKAWEELKRSDQKVQMTLERERRLLLRQSQEQWQEKEQRKTLQSPEQRDLRRDSQRKNVPPGESRWKEQPEDQESPRQEKLEKARAQAEHRKQCQVRRLLEQEKMLRNLREQHSLQLQRRLVEACRKRHLHAVEGQKKVQDTNLSSLINYQARKVLMDCQAKAEELLRQLSLEQSFQRSQEIHQGLRKERQRELREKAQKEEEQLQQARWRAGESEEQRKMRKRILVELADEKIRQARSHVHKTTRDKVQHLRELNHLREKNHHILKLKAEKEEKCHIEGIKEAIKKKEQRVQHISQGKDPNFQEFQKLPQASRREERAPPNSSLDQMVLEAQLRACQQNRGY

SEQ ID NO: 28526 - protein, 167 aa, Homo sapiens
MTAGTVVITGGILATVILLCIIAVLCYCRLQYYCCKKSGTEVADEEEEREHDLPTHPRGPTCNACSSQALDGRGSLAPLTSEPCSQPCGVAASHCTTCSPYSSPFYIRTADMVPNGGGGERLSFAPTYYKEGGPPSLKLAAPQSYPVTWPGSGREAFTNPRAISTDV

SEQ ID NO: 28527 - protein, 171 aa, Homo sapiens
MWTLKSSLVLLLCLTCSYAFMFSSLRQKTSEPQGKVQYGEHFRIRQNLPEHTQGWLGSKWLWLLFVVVPFVILQCQRDSEKNKEQSPPGLRGGQLHSPLKKKRNASPNKDCAFNTLMELEVELMKFVSKVRNLKRAMATGSGSNLRLRKSEMPADPYHVTICEIWGEESSS

SEQ ID NO: 28528 - protein, 469 aa, Homo sapiens
MCVICFVKALVRVFKIYLTASYTYPFRGWPVAFRWDDVRAVGRSSSHRALTCAAAAAGVWLLRDETLGGDALGRPPRGARSQAQCLLQQLRELPGQLASYALAHSLGRWLVYPGSVSLMTRALLPLLQQGQERLVERYHGRRAKLVACDGNEIDTMFMDRRQHPGSHVHGPRLVICCEGNAGFYEMGCLSAPLEAGYSVLGWNHPGFGSSTGVPFPQHDANAMDVVVEYALHRLHFPPAHLVVYGWSVGGFTATWATMTYPELGALVLDATFDDLVPLALKVMPHSWKGLVVRTVREHFNLNVAEQLCCYPGPVLLLRRTQDDVVSTSGRLRPLSPGDVEGNRGNELLLRLLEHRYPVVMAREGRAVVTRWLRAGSLAQEAAFYARYRVDEDWCLALLRSYRARCEEELEGEEALGPHGPAFPWLVGQGLSSRRRRRLALFLARKHLKNVEATHFSPLEPEEFQLPWRL

SEQ ID NO: 28529 - protein, 572 aa, Homo sapiens
MRRHMVTYAWQLLKKELGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAEPLQLLLAKVMRFERFGRRRVIIKKGQKGNSFYFIYLGTVAITKDEDGSSAFLDPHPKLLHKGSCFGEMDVLHASVRRSTIVCMEETEFLVVDREDFFANKLDQEVQKDAQYRFEFFRKMELFASWSDEKLWQLVAMAKIERFSYGQLISKDFGESPFIMFISKGSCEVLRLLDLGASPSYRRWIWQHLELIDGRPLKTHLSEYSPMERFKEFQIKSYPLQDFSSLKLPHLKKAWGLQGTSFSRKIRTSGDTLSKMLGPKIQSRPAQSIKCAMINIKPGELPKEAAVGAYVKVHTVEQGEILAFLPEGECDTRPLILMSLGNELIRIRKEIFYELIDNDDEMIKKLLKLNIAFPSDEDMCQKFLQQNSWNIFRKDLLQLLVEPCQSQLFTPNRPKKREIYNPKSVVLDLCSINKTTKPRYPIFMAPQKYLPPLRIVQAIKAPRYKIRELLA

SEQ ID NO: 28530 - protein, 149 aa, Homo sapiens
MLSGPHPSPTFRPNPCPWPCLHSLWMEISPTQLCFLSPGPSPQSPSCCFQGMNSGSELGKLWRKLFKGIPRLSVSHFDFYCGTCVLLGRPQIPQGSSLGNDIDQYPVVFRNASDQGSWMQLEMLLRKLSDLVWTSDALSDKILEDGLVP

SEQ ID NO: 28531 - protein, 578 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDTVITPYGECILGAGGYIFNTEAHPIDPAALHCCQRLKEEQWEVEDLMREFYSLKRCRSKFQKNTVSSGPWEPPARPGTLFSPENHDQARERKPAKQKVPLLSCPSQPFTSKLALLGQVFLDSS

SEQ ID NO: 28532 - protein, 254 aa, Homo sapiens
MMCPLWRLLIFLGLLALPLAPHKQPWPGLAQAHRDNKSTLARIIAQGLIKHNAESRIQNIHFGDRLNASAQVAPGLVGWLISGRKHQQQQESSINITNIQLDCGGIQISFHKEWFSANISLEFDLELRPSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 28533 - protein, 210 aa, Homo sapiens
MMCPLWRLLIFLGLLALPLAPHKQPWPGLAQAHRDNKSTLARIIAQGLIKHNAESRIQNIHFGDRLNASAQVAPGLVGWLISGRKHQQQQESSINITNIQLDCGGIQISFHKEWFSANISLEFDLELRPSFDNNIVKMCAHMSIVVEFWLEKDEFGRRDLVIGKCDAEPSSVHVAILTEAIPPKMNQFLYNLKENLQKVLPHMVESQPLA

SEQ ID NO: 28534 - protein, 1873 aa, Homo sapiens
MFSRRSHGDVKKSTQKVLDPKKDVLTRLKHLRALLDNVDANDLKQFFETNYSQIYFIFYENFIALENSLKLKGNNKSQREELDSILFLFEKILQFLPERIFFRWHYQSIGSTLKKLLHTGNSIKIRCEGIRLFLLWLQALQTNCAEEQVLIFACLVPGFPAVMSSRGPCTLETLINPSPSVADVKIYPEEITPLLPAISGEKIAEDQTCFFLQILLKYMVIQAASLEWKNKENQDTGFKFLFTLFRKYYLPHLFPSFTKLTNIYKPVLDIPHLRPKPVYITTTRDNENIYSTKIPYMAARVVFIKWIVTFFLEKKYLTATQNTKNGVDVLPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKQIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPSGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSFYEERALYLEAIIQNHREVMTFEDFAAQVFSPSPSYSLSGTD

SEQ ID NO: 28535 - protein, 156 aa, Homo sapiens
MWKRSDHQPKIKAEDGPLVGQFEVLGSVPEPAMPHPLELSEFESFPVFQDIRLHIREVGAQLVKKVNAVFQLDITKNGKTILRWTIDLKNGSGDMYPGPARLPADTVFTIPESVFMELVLGKMNPQKAFLAGKFKVSGKVLLSWKLERVFKDWAKF

SEQ ID NO: 28536 - protein, 186 aa, Homo sapiens
MVRPKKVCFSESSLPTGDRTRRSYYLNEIQSFAGAEKDARVVGEIAFQLDRRILAYVFPGVTRLYGFTVANIPEKIEQTSTKSLDGSVDERKLRELTQRYLALSARLEKLGYSRDVHPAFSEFLINTYGILKQRPDLRANPLHSSPAALRKLVIDVVPPKFLGDSLLLLNCLCELSKEDGKPLFAW

SEQ ID NO: 28537 - protein, 217 aa, Homo sapiens
MASQKQMEVVTKGTGFRRRPKTITYTPGTCELFRVMMKESKLTNIQQRHIMDIMKRGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELVKEIQERKEFLADMEALGQGKQYRGIILAEISQKLREMEDIDHRRSEELRKGLATT

SEQ ID NO: 28538 - protein, 501 aa, Homo sapiens
MGCGLRKLEDPDDSSPGKIFSTLKRPQVETKTEFAYEYVLLDFTLQASSNPEVIKINSILDIVTKVENYYLKGYIVGAIHPVIQPVGQRKHLPASYLYRVVLLRLKLSPKNSAAPSGQRRPRLVIEECPLTSEAQTNDAAKELIEKINVAAKRGMKFVGFISQHYSPSKFCNGTNHDGDIESMLHVRHGSDENCRSWNEGTLSGQSSESGIEEELHHESGQYQMEQNGSPTSSKSRKGEASDNKLYTVFNAFDDDSTSWAYQEGILSMKVTRKGSVISTLDADWLELTTFYYKQGLSLIDSFVFWETSKGEHLPKSLEGFFIYEEEGSGVPGSSRKGNDAIVVEQWTVIEGCEIKTDYGPLLHTLAEFGWLLTSVLPTPVLRHDSEGNLATKQIVFLQRPVMWNSAAQTPDKKASHHIKGEDKNKATSRSIGLDTTSSQPAESRHLPEECRLSPSRECWTKEGRLAQHNSFSGFSSSDNVLRELDDGQFDQEDGVTQVTCM

SEQ ID NO: 28539 - protein, 141 aa, Homo sapiens
MDSSACKKSHQSKKWRIQAQENFAKKFPYRLSWLTEPDPEPLQPWEVTNDSNTVQLPLQKRLVPTRSIPVRGLGAPDFTSPSGSCPAPLPAPSPPPLCNLWELKLLSRRFPRQLAFLLSTRHTEAACPQTSKAAGLSRGLS

SEQ ID NO: 28540 - protein, 177 aa, Homo sapiens
MAGYQLWSPWTPLDESFQWLRHTTPTPSSKHPFKASPCFPHTPSDLEVQLCFQEVTLVLDSPFLESGVSPKLPCHTSELRTMNNKGLVRKPQPIRLSGVDSVFGRVITAQPPKWTGTFRVSDKSAFCKIISREHQWPIGLKEPQIQMTVTMCKQMLRSILLLYATYKKCTFALQHSK

SEQ ID NO: 28541 - protein, 536 aa, Homo sapiens
MEEPPQEALAEPLKHESPAAPSSAGHTKGQEEDDQKNQAERKADNHTAHRIADQTALRVPSQAESSIFSQATNGVAEQNGHSTPGQAGRRASNPADVSDLRADDQVNQTPSEQTKGKASSQANNVQHEQSDGQVSGLTEERTAEQTERRLPTQAERRTSGQIDGRLAMPSDQRGSRQTDHRMAGQSERRASEQMDRRMSGEAERRTSEQITHRLSKLSERRPSVQIDSGSSVPSDQSPSVQIDSGSSVPSDQRPSVQIDRRMSGKVRRRSSEKTDYRLAGLADPGTSEQTDLRLYGLVDHKTSVKTHHQVYGQATELAEHQAIDQAHSNADQPPVDNAHYTESDQTDHLADRQANHKDQLSYYETRGQSEDRIFPQLGNSKEDKEADYRVQPCKFEDSQVDLNSKPSVEMETQNATTIPPYNPVDARFTSNFQAKDQALFPRLPSILSKLNYTSSQEKTQAIVTKSDEFSEIDQGKGYHIRNQTYRRFPSIVYEDPYQVSLQYMEKHHILQIFQQITENLVYEKPEDPLNFMLCQV

SEQ ID NO: 28542 - protein, 663 aa, Homo sapiens
MAHLRSPSGFGDPGKKDQKESEEELEEEEEEEEVEEEEEEVEEEEEEVEEEEEEVVEEELVGEEQELEAPETFSEEYLWKVTDIGDYDDDFPDVRPRLASIVSPSLTSTFVPSQSATSTETPSASPPSSTSSHKSFPKIFQTFRKDMSEMSIDRNIHRNLSPGIPVSVQTEESWLQDLSDKVQSRKKASKEKAEPECLASKLREKWVINPEESKLNILYELEFKEDFITLFEPSLRTLPSIGPPSILAYKEESSNLGINFKDEEEETSPKCEFCGSDLRAFFSNVDVSSEPKGHASCCIAFQNLIDYIYEEQIKTKPPKAELIAIDPHAAHGSEVDRLKAKEKALQRKQEQRMARHFAIISREQTHFSEDDSKRLKTISYQLSVDIPEKQIIDDIVFDFQLRNSNMSIICCDSRIACGKVVRNELLEKHYKHGSKFLTSFPDGTTQIFYPSGNLAIIRVPNKVNGFTCIVQEDMPTNPAILAVLDSSGRSSCYHPNGNVWVYINILGGQYSDQAGNRIRAWNWSNSITSSPFVSFKPVFLALNRYIGVRILEQDKISITFLAMGQQARISVGTKVKLPNPEEIPILRYVSGDDLLLLASLIKIRRLFHKLEGCVNFPSSQVWEKLKQPSYLSSLSLKLIALCHSSGIKQDIMKTIRNIINEEI

SEQ ID NO: 28543 - protein, 352 aa, Homo sapiens
MSTNNALRVFWKSREWNMKTSTFDSDEDILLLPKRKRFRKKKSRPVRHTKRHEEEQVYEQGTTLPCSICKHEIDLTGIFLHKKQHVALATLGFQWMGRKKPQPSVIAVQRQFMISKLLSSFMFTEKTLQSINNAFELLWKKQIPAYYKIFDNIDRSVIYSQKICHLLIKGVGICEDRNSTWKADMNDKFTVVSNFGNKPNVCFFGLFDGHHGASAAELTSMELPVLLLHQLSKFDPSYQMTTDEQQIINSFYTVFREEYTAIEDLFSAINKTEAVRCEYEDTHKAFAKAFWRMDRLLGLGRKEVSRVQWSGCSAVTCILEGKPKSPYAHKNWKRKNTHDGLAESSPSRRCQK

SEQ ID NO: 28544 - protein, 359 aa, Homo sapiens
MNLNPPTSALQIEGKGSHIMARNVSCFLVRHTPHPRRVCHIKGLNNIPICTVNDDENAFGTLWEVGQSNYLEKNRIPFANCSYPPSTAVQKSPVRGMSPAPNGAKVPPRPHSEPSRKIKECFKTSSENPLVIKKEEIKAKRPPSPPKACSTPGSCSSGMTSTKNDVKANTICIPNYLDQEIKILAKLCSILHTDSLAEVLQWLLHATSKEKEWVSALIHSELAEINLLTHHRRNTSMEPAAETGKPPTVKSPPTVKLPPNFTAKSKVLTRDTEGDQPTRVSSQGSEENKEVPKEAEHKPPLLIRRNNMKIPVAEYFSKPNSPPRPNTQESGSAKPVSARSIQEYNLCPQRACYPSTHRR

SEQ ID NO: 28545 - protein, 915 aa, Homo sapiens
MRKSSSPSLSNCNSVLANKIFGIPLDELQQGGHPDIEVPFIVRHVVDYIEEHGGLEQQGLFQVNGNAETVEWLRQRYDSGEEVDLVKEADVPSAISLLRFFLQELPEPVIPGSLHIHLMQLSQDYNNEDEFGRKLRFLLQQLPPVNYSLLKFLCRFLANVASHHEEIWSANSLAAVFGPDVFHIYTDVEDMKEQEIVSRIMAGLLENYYEFFENEEEDFSSNDLSSITEQVNELSEEEEEDEKLEHIEELPEEGAEKSNDMPEVVQLRMTENILESNSVTATSTHISPISILPASTDILERTIRAAVEQHLFDLQSSIDHDLKNLQQQSVVCNNEAESIHCDGEGSNNQIDIADDIINASESNRDCSKPVASTNLDNEAMQQDCVFENEENTQSVGILLEPCSDRGDSEDGCLEREEYLLFDSDKLSHLILDSSSKICDLNANTESEVPGGQSVGVQGEAACVSIPHLDLKNVSDGDKWEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKPSYSDIAANPKVLKWMTELTKLRKQIKDAKHKNSDGEFVPQTRPRSNTLPKSFGSSLDHEDEENEDEPKVIQKEKKPSKEATLELILKRLKEKRIERCLPEDIKKMTKDHLVEEKASLQKSLLYYESQHGRPVTKEERHIVKPLYDRYRLVKQMLTRASITPVLGSPSTKRRGQMLQPIIEGETAHFFEEIKEEEEDGVNLSSELGDMLKTAVQVQSSLENSESDVEENQEKLALDLRLSSSRAASMPELLEQLWKARAEKKKLRKTLREFEEAFYQQNGRNAQKEDRVPVLEEYREYKKIKAKLRLLEVLISKQDSSKSI

SEQ ID NO: 28546 - protein, 563 aa, Homo sapiens
MTVLEITLAVILTLLGLAILAILLTRWARRKQSEMHISRYSSEQSARLLDYEDGRGSRHAYSTQSDTSCDNRERSKRDYTPSTNSLVSMASKFSLGQTELILLLMCFILALSRSSIGSIKCLQTTEELPSRTAGAMMQFTAPIPGATGPIKLSQKTIVQTPGPIVQYPGPNAGPPSAPRGPPMAPIIISQRTARIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 28547 - protein, 947 aa, Homo sapiens
MSQPPIGGAAPATAAASPAAAATEARLHPEGSSRKQQRAQSPARPRDSSLRQTIAATRSPVGAGTKLNSVRQQQLQQQQQQGNKTGSRTGPPASIRGGGGGAEKATPLAPKGAAPGAVQPVAGAEAAPAATLAALGGRRPGPPEEPPRELESVPSKLGEPPPLGEGGGGGGEGGGAGGGSGEREGGAPQPPPPRGWRGKGVRAQQRGGSGGEGASPSPSSSSAGKTPGTGSRNSGSGVAGGGSGGGGSYWKEGCLQSELIQFHLKKERAAAAAAAAQMHAKNGGGSSSRSSPVSGPPAVCETLAVASASPMAAAAEGPQQSAEGSASGGGMQAAAPPSSQPHPQQLQEQEEMQEEMEKLREENETLKNEIDELRTEMDEMRDTFFEEDACQLQEMRHELERANKNCRILQYRLRKAERKRLRYAQTGEIDGELLRSLEQDLKVAKDVSVRLHHELENVEEKRTTTEDENEKLRQQLIEVEIAKQALQNELEKMKELSLKRRGSKDLPKSEKKAQQTPTEEDNEDLKCQLQFVKEEAALMRKKMAKIDKEKDRFEHELQKYRSFYGDLDSPLPKGEAGGPPSTREAELKLRLRLVEEEANILGRKIVELEVENRGLKAELDDLRGDDFNGSANPLMREQSESLSELRQHLQLVEDETELLRRNVADLEEQNKRITAELNKYKYKSGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISVSQMFQPIILLILILVLFSSLSYTTIFKLVFLFTLFFVL

SEQ ID NO: 28548 - protein, 131 aa, Homo sapiens
MASGPLGPGARPTRLHPPFPPPAHIKPGAPPGENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTE

SEQ ID NO: 28549 - protein, 385 aa, Homo sapiens
MSVQNSGWPHQEDSPKPQDPGPPANSDSDSGHLPGEDPEDTHAQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGETGLDRTEGRDQTSVNSATLSRTLLLAAAGGSSLQTQRGLPGSSPQQENRPGDKAEAPKGQEQCRLETIRDPKDTPFSTCSSSSDSEPEGFFLGERLPQSWKTPGSLQAEDSNASKTHCTMC

SEQ ID NO: 28550 - protein, 367 aa, Homo sapiens
MGKSIPQYLGQLDIRKSVVSLATGAGAIYLLYKAIKAGIKCKPPLCSNSPICIARECPGPGERALPQEAPAPEASAVGGPKGLAVERERHGRDSGELRRLLNSLECKQDEYAKSMILHSITRCVYLLEAEASACTTDDIVLLGYMLDDKDNSVKTQALNTLKAFSGIRKFRLKIQEHSIKVLELISTIWDTELHIAGLRLLNNLPLPDYVHPQLRRVMPALMEILQSDYILAQVQAVRLLSYLAQKNDLLYDILNCQVHSNFLNLFQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 28551 - protein, 26 aa, Homo sapiens
MTSRDLSRPVSRKRFICGRDLPCLRN

SEQ ID NO: 28552 - protein, 26 aa, Homo sapiens
MTSRDLSRPVSRKRFICGRDLPCLRN

SEQ ID NO: 28553 - protein, 222 aa, Homo sapiens
MAGAEPFLADGNQELFPCEVCGRRFAADVLERHGPICKKLFNRKRKPFSSLKQRLQGTDIPTVKKTPQSKSPPVRKSNWRQQHEDFINAIRSAKQCMLAIKEGRPLPPPPPPSLNPDYIQRPYCMRRFNESAAERHTNFCKDQSSRRVFNPAQTAAKLASRAQGRAQMGPKKEPTVTSAVGALLQNRVLVATNEVPTKSGLAMDPASGAKLRQGFSKSSKKD

SEQ ID NO: 28554 - protein, 222 aa, Homo sapiens; identical to SEQ ID NO: 28553

SEQ ID NO: 28555 - protein, 590 aa, Homo sapiens
MEVIHGRPYCCRELEGADILSNTFYSNELHNPLQTVTRPTASEDRYQELRESLQQCRLPWGAEREYGGIIPISLPEDHRPKYEPPRVMGKGHQHYGFGGETWPRKLPVEQFYYLTQNKKSDVYGNDSLIPKPPNSTVGEICLPYPIEHPYHTHICRGAMFPTFTSPEDLYTGIKARTQQPFPPTVPTKAYDSTVLKTRGNPYRYELIDIPMDSKKKALTWPGQGVYYDFPRGVEKNKPVFYPKPPKTFAPNTSLNSWDPICSAKEANIQRNLERSHWLTSYTHDFTGLGPMDPLELDDYHEKMVAELTRKIGFDPEPQEKFHPVFKPPRPLEGRIARLIQNRRSLEAIVQQRPRSCPDCTPRVLCNFHTFVPSSKEMVALSDNIPAGVTHKNQDIEEKIIEEQSLLSTYELPSCYPTKDLTSIYDIKPFPKITDTKKTEDLYWRQQSLKTQPTPYCKPDHWIHYENLKSPLRDQYNMCPDPVSLSKPSVLQNKQDTEAFTLEHFLSKPEEELFLNMENNEETRPVLGWIPRAGVTKPQTNLLELKNSFSKTGAQKRFHKSILEDHKDLRDNEHSGMKHQFYGHNSYYFYN

SEQ ID NO: 28556 - protein, 122 aa, Homo sapiens
MPPLAPQLCRAVFLVPILLLLQVKPLNGSPGPKDGSQTEKTPSADQNQEQFEEHFVASSVGEMWQVVDMAQQEEDQSSKTAAVHKHSFHLSFCFSLASVMVFSGGPLRRTFPNIQLCFMLTH

SEQ ID NO: 28557 - protein, 258 aa, Homo sapiens
MVWGRAGSWGRVWGGFGGEGAGLVLGVPRPRLSPARPTGPASRRSRRQSVRRPGGTRSHSPTHGRRDAGARLTMWKLGRGRVLLDEPPEEEDGLRGGPPPAAAAAAQAQVQGASFRGWKEVTSLFNKDDEQHLLERCKSPKSKGTNLRLKEELKAEKKSGFWDNLVLKQNIQSKKPDEIEGWEPPKLALEDISADPEDTVGGHPSWSGWEDDAKGSTKYTSLASSANSSRWSLRAAGRLVSIRRQSKGHLTDSPEEAE

SEQ ID NO: 28558 - protein, 146 aa, Homo sapiens
MATFHRAHATSSVKPRARRHQEPNSGDWPGSYRAGTRCSAIGFRLLHSPQHWRPRSLGAGQGREDPSWEGGALGDLKALWDQPCQPPPWVQLQLSSAYGARQQRWQLSTLPEPPAARTPGQMPQQRLIRAAGPSAAGGGNQWLSPM

SEQ ID NO: 28559 - protein, 146 aa, Homo sapiens; identical to SEQ ID NO: 28558

SEQ ID NO: 28560 - protein, 101 aa, Homo sapiens
MFLTGDTSPAEDNREATLPQCSLPELYACIENFNKESKKSNLLKMHGISLNEAQEVLARNLNVMSFTRGADVRGDLQPVISVNKMNKPGKHRKTPSPKINK

SEQ ID NO: 28561 - protein, 328 aa, Homo sapiens
MASRCSEPYPEVSRIPTVRGCNGSLSGALSCCEDSAQGSGPPKAPTVAEGPSSCLRRNVISERERRKRMSLSCERLRALLPQFDGRREDMASVLEMSVQFLRLASALGPSQEQHAILASSKEMWHSLQEDVLQLTLSSQIQAGVPDPGTGASSGTRTPDVKAFLESPWSLDPASASPEPVPHILASSRQWDPASCTSLGTDKCEALLGLCQVRGGLPPFSEPSSLVPWPPGRSLPKAVRPPLSWPPFSQQQTLPVMSGEALGWLGQAGSLAMGAAPLGEPAKEDPMLAQEAGSALGSDVDDGTSFLLTAGPSSWPGEWGPGFRAGPPA

SEQ ID NO: 28562 - protein, 461 aa, Homo sapiens
MDLPDESQWDETTCGLAVCQHPQCWATIRRIERGHPRILGSSCKTPLDAEDKLPVLTVVDILDSGFAAHHLPECTFTKAHSLLSQSSKFYSKFHGRPPKGLPDKSLINCTNRLPKFPVLNLNETQLPCPEDVRNMVVLWIPEETEIHVSQHGKKKRKNSAVKSKSFLGLSGNQSAGTRVGTPGMIVPPPTPVQLSEQFSSDFLPLWAQSEALPQDLLKELLPGGKQTMLCPEMKIKLAMMKKNLPLEKNRPDSVISSKMFLSIHRLTLERPALRYPERLKKLHNLKTEGYRKQQQRQQQQQQQQKKVKTPIKKQEAKKKAKSDPGIQSTSHKHPVTTVHDRLYGYRTLPGQNSDMKQQQQMEKGTTSKQDSTERPKMNYYDHADFHHSVKSPELYETEPTNKDISAPVDAVPEAQAARQKKISFNFSEIMASTGWNSELKLLRILQDTDDEDEEDQSSGAE

SEQ ID NO: 28563 - protein, 168 aa, Homo sapiens
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLILDLMKEWIAHSEKLPRKVLQHGTT

SEQ ID NO: 28564 - protein, 493 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 28565 - protein, 281 aa, Homo sapiens
MEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 28566 - protein, 379 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 28567 - protein, 475 aa, Homo sapiens
MISSKPRLVVPYGLKTLLEGISRAVLKTNPSNINQFAAAYFQELTMYRVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 28568 - protein, 379 aa, Homo sapiens; identical to SEQ ID NO: 28566

SEQ ID NO: 28569 - protein, 221 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLEDVAKKSSGSGDKCAPFGSYGIAGEVTVTTAHKRRKAETEN

SEQ ID NO: 28570 - protein, 700 aa, Homo sapiens
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKELLKHKDRITTFRELIAKEKAFQDHAIKVFQGV

SEQ ID NO: 28571 - protein, 641 aa, Homo sapiens
MTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKEVIDCDSDEAKSIRDVPTLLGAKLDKYHSLNEELDFLVTSYEEIIECADQRLAISHSQIAHLEERNKHLEDLIRKPREKARKPRSKSLENHPKSMTMMPALFKENRNDLD

SEQ ID NO: 28572 - protein, 384 aa, Homo sapiens
MARALVQFWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 28573 - protein, 401 aa, Homo sapiens
MPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGYLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 28574 - protein, 76 aa, Homo sapiens
MAGTRGLMLLGPGPVAGPRDVGTCRGRQMEIQKHKDNKKLPQGIIIVFRLQTHTTPQIYTQLKGKLRKFFKEPYSE

SEQ ID NO: 28575 - protein, 102 aa, Homo sapiens
MTQEKMYPHLFSERCANQHQHRTAEEKKYVSEKQLIHWRCEEPSAHHNSIDIKRMKHFGSALRLRQTFHLDTADHPCVITMNPALPWKLEGSNSTSTLPLPA

SEQ ID NO: 28576 - protein, 2316 aa, Homo sapiens
MDGVSSEANEENDNIERPVRRRHSSILKPPRSPLQDLRGGNERVQESNALRNKKNSRRVSFADTIKVFQTESHMKIVRKSEMEETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYAKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENMDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCGQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTFVYDTIQLTITFEESVVGFPFLDKRYRKIVDVNFQSLLDEDQAPPSSLLVHKLIFQYVEEKESWKKTCTTQHQLPKMLEEFSLVVHHCRLLGEEIEYLKRWGPNYNLMNIDINNNELRLLFSSSAAFAKFEITLFLSAYYPSVPLPSTIQNHVGNTSQDDIATILSKVPLENNYLKNVVKQIYQDLFQDCHFYH

SEQ ID NO: 28577 - protein, 2342 aa, Homo sapiens
MDGVSSEANEENDNIERPVRRRHSSILKPPRSPLQDLRGGNERVQESNALRNKKNSRRVSFADTIKVFQTESHMKIVRKSEMEGCSAMVPSQLQLLPPGFKRFSCLSLPETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYAKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENMDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCGQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTFVYDTIQLTITFEESVVGFPFLDKRYRKIVDVNFQSLLDEDQAPPSSLLVHKLIFQYVEEKESWKKTCTTQHQLPKMLEEFSLVVHHCRLLGEEIEYLKRWGPNYNLMNIDINNNELRLLFSSSAAFAKFEITLFLSAYYPSVPLPSTIQNHVGNTSQDDIATILSKVPLENNYLKNVVKQIYQDLFQDCHFYH

SEQ ID NO: 28578 - protein, 398 aa, Homo sapiens
MSQHRHQRHSRVISSSPVDTTSVGFCPTFKKFKRNDDECRAFVKRVIMSRFFKIIMISTVTSNAFFMALWTSYDIRYRLFRLLEFSEIFFVSICTSELSMKVYVDPINYWKNGYNLLDVIIIIVMFLPYALRQLMGKQFTYLYIADGMQSLRILKLIGYSQGIRTLITAVGQTVYTVASVLLLLFLLMYIFAILGFCLFGSPDNGDHDNWGNLAAAFFTLFSLATVDGWTDLQKQLDNREFALSRAFTIIFILLASFIFLNMFVGVMIMHTEDSIRKFERELMLEQQEMLMGEKQVILQRQQEEISRLMHIQKNADCTSFSELVENFKKTLSHTDPMVLDDFGTSLPFIDIYFSTLDYQDTTVHKLQELYYEIVHVLSLMLEDLPQEKPQSLEKVDEK

SEQ ID NO: 28579 - protein, 185 aa, Homo sapiens
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSYPSEDDDKKDDKN

SEQ ID NO: 28580 - protein, 1417 aa, Homo sapiens
MASPTNGHHGGNCGKCSPGRAPLVGSGALADHDPRQAPRLRRRLTQSAPGRGSDRVGASQRLPRRFEFCAAGVRWFSELCPRLPRAGARERVRGFLTQTRVRSAQSPGGSLPSDDLGEMESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVAESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMEKNEKIRSLETNINTEHEKICLAFEKAKKIHLEQHKEMEKQIERLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQKIIKLEGTLEKSELELKECNKQIESLNDKLQNAKEQLREKEFIMLQNEQEISQLKKEIERTQQRMKEMESVMKEQEQYIATQYKEAIDLGQELRLTREQVQNSHTELAEARHQQVQAQREIERLSSELEDMKQLSKEKDAHGNHLAEELGASKVREAHLEARMQAEIKKLSAEVESLKEAYHMEMISHQENHAKWKISADSQKSSVQQLNEQLEKAKLELEEAQDTVSNLHQQVQDRNEVIEAANEALLTKGENV

SEQ ID NO: 28581 - protein, 611 aa, Homo sapiens
MSEIPSTIVSKNMTNDKNSLESMNISSSSSTEENPEKQARKNEEHGPDPSANPFHLSGDVDFFLLRDQERNKALSERQQQKTMRVHQKMTYSSKVSAKHTSLRRQLQLEDKQEDLEARAEAEHQRAFRDYTTWKLTLTKEKNVEPENMSGYIKQKRQMFLLQYALDVKRREIQRLETLATKEEARLERAEKSLEKDAALFDEFVRENDCSSVQAMRAAEKETKAKIEKILEIRDLTTQIVNIKGEISRFEDTLKHYKVYKDFLYKLSPKEWLEEQEKKHSFLKKAKEVSEASKESSVNSTPGDKGPGIKGKASSMWAKEGQGTKKPWRFLQTMRLGRSPSYLSSPQQGSQPSESSGGDSRGSNSPIPPTQEDTDSDGEEPQLYFTEPQQLLDVFRELEEQNLSLIQNSQETEKTLEELSHTLKHTQIRMDREVNQLKQWVTTMMMSITKEEDTAAELELKARVFHFGEYKGDQQDKLLESLNCKVLDVYRHCTGTQQEANLGTVQMLTIIEHQLDELLENLEHVPQVKIEQAERAKEKERRIRLREEKLQMQKILQEEHLQRARARAQAEIKKKRGRTLVCRSRPPAHRIKQQSEHTLMDKEEEELLFFFT

SEQ ID NO: 28582 - protein, 416 aa, Homo sapiens
MQGAPRARFGSRTPPAAAASSSSPSCTPATSQGHLRTPAQPPPASPAASSSSSFAAVVRYGPGAAAAAGTGGTGSDSASLELSAESRMILDAFAQQCSRVLSLLNCGGKLLDSNHSQSMISCVKQEGSSYNERQEHCHIGKGVHSQTSDNVDIEMQYMQRKQQTSAFLRVFTDSLQNYLLSGSFPTPNPSSASEYGHLADVDPLSTSPVHTLGGWTSPATSESHGHPSSSTLPEEEEEEDEEGYCPRCQELEQEVISLQQENEELRRKLESIPVPCQTVLDYLKMVLQHHNQLLIPQPADQPTEGSKQLLNNYPVYITSKQWDEAVNSSKKDGRRLLRYLIRFVFTTDELKYSCGLGKRKRSVQSGETGPERRPLDPVKVTCLRGTASFRSVSPSVISFHRIGCGSPRTSVQPSVF

SEQ ID NO: 28583 - protein, 316 aa, Homo sapiens
MSLGIMEEEDLAEYFRLQYGERLLQMLQKLPNVEGASESLSIWLLEKKKETEIMHQTMVQKKKMFQRRMETLNLRWEELGVKEAQLKAHIQKSEQFIQENDQKRIRAMKKANKERELKCQHMQELTKRKQEMVALRLEHQRLSAKLKDYYIFNKYLEKVVENSEFEEIHEVIARYKTLVSMRHDLMQSAQEGQEKIERAKARLARYMEEKDDEILQQNNELARLQMRFDRARSNVIFWESRWAHIQNTAAKKTLLLGTIKMATLNLFQIVSKHLKEVTEVALEDTHKQLDMIQQFIQDRSDIWAEVKKKEQQRVRI

SEQ ID NO: 28584 - protein, 211 aa, Homo sapiens
MWASLSLDHPSAKENQALRLIEMREENGNVPKTEQAGSLKPLRDTGKSNLKEKKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 28585 - protein, 955 aa, Homo sapiens
MEVGSEEEKWEKLDAEFDHFVVDMKPFVLKLPHRTERQRCALWIRKLCEPSGTGAGIMGRKNRNLYAKLLLHMLKRGALEGPFTHRPEPGTLKILPSYMSIYFDEPNPARAKGSSPEGLPAWVLGELETSEHKLNESWKLSSGEDNTLVQSPTDVYSREQYTGKLRVRSHSLSPTHREDGQNITPKICEVYSKKSPVSLDDSDIEARLNSWNLGIENPRYLRQKPIPVSLMTPKFSLRKSSSFHDDHFLSRIREKELDMKTKMMEAKFHEEKLKLQQKHDADVQKILERKNNEIEELKTLYRSKQHETEETIRKLEKKVQTLIRDCQVIRETKEDQIAELKKICEQSTESLNNDWEKKLHNAVAEMEQEKFDLQKQHTENIQELLEDTNVRLNKMESEYMAQTQSTNHMIKELEARVQQLTGEAENSNLQRQKLIQEKAELERCYQITCSELQEVKARRNTLHKEKDHLVNDYEQNMKLLQTKYDADINLLKQEHALSASKASSMIEELEQNVCQLKQQLQESELQRKQQLRDQENKFQMEKSHLKHIYEKKAHDLQSELDKGKEDTQKKIHKFEEALKEKEEQLTRVTEVQRLQAQQADAALEEFKRQVELNSEKVYAEMKEQMEKVEADLTRSKSLREKQSKEFLWQLEDIRQRYEQQIVELKLEHEQEKTHLLQQHNAEKDSLVRDHEREIENLEKQLRAANMEHENQIQEFKKRDAQVIADMEAQVHKLREELINVNSQRKQQLVELGLLREEEKQRATREHEIVVNKLKAESEKMKIELKKTHAAETEMTLEKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 28586 - protein, 328 aa, Homo sapiens
MYTLHTKRVKAAARQMWTSNLSKVRQSLKNVYHKCKIRHQDSTGYPTVTSDDCNQDDDSYDGKMNLPVVLQDVKTAQVELFSQMTDIVHMIPKVQEKTDLYQKQMEVLETRMNVNEDKQCTTTKDILSMKEDIKALKKKVTELEIQNSCSTIHCLEILEGERGKEITELLYKLIQPATLKNTLASTDMEISSAEPEKVPSYPKSTDHLEKKTISPQMKTLKKRNHQNASRSFEKAKPNIYIYPDFSTWIKLTFVHGGKWTFFLSATKLEEFIQWLLSRPTILPEEPQVITQRYCPFTGPILSLTTICLSIFNNIYGFICSLKEEVTRL

SEQ ID NO: 28587 - protein, 684 aa, Homo sapiens
MNPPAAFLAGRQNIGSEVEISTIEKQRKELQLLIGELKDRDKELNDMVAVHQQQLLSWEEDRQKVLTLEERCSKLEGELHKRTEIIRSLTKKVKALESNQMECQTALQKTQLQLQEMAQKATHSSLLSEDLEARNETLSNTLVELSAQVGQLQAREQALTTMIKLKDKDIIEAVNHIADCSGKFKMLEHALRDAKMAETCIVKEKQDYKQKLKALKIEVNKLKEDLNEKTTENNEQREEIIRLKQEKSCLHDELLFTVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELSTLLPISHENLTGSATNKSEVPEESAQKNTFVSY

SEQ ID NO: 28588 - protein, 563 aa, Homo sapiens
MSVLKKNRRKDSDTPQEPSEKAKEQQAEAELRKLRQQFRKMVESRKSFKFRNQQKIASQYKEIKTLKTEQDEITLLLSLMKSSRNMNRSEKNYMELRLLLQTKEDYEALIKSLKVLLAELDEKILQMEKKIANQKQIFAKMQEANNPRKLQKQIHILETRLNLVTVHFDKMLTTNAKLRKEIEDLRFEKAAYDNVYQQLQHCLLMEKKTMNLAIEQSSQAYEQRVEAMARMAAMKDRQKKDTSQYNLEIRELERLYAHESKLKSFLLVKLNDRNEFEEQAKREEALKAKKHVKKNRGESFESYEVAHLRLLKLAESGNLNQLIEDFLAKEEKNFARFTYVTELNNDMEMMHKRTQRIQDEIILLRSQQKLSHDDNHSVLRQLEDKLRKTTEEADMYESKYGEVSKTLDLLKNSVEKLFKKINCDATKILVQLGETGKVTDINLPQYFAIIEKKTNDLLLLETYRRILEVEGAEAEIPPPFINPFWGGSALLKPPEPIKVIPPVLGADPFSDRLDDVEQPLDHSSLRQLVLDNYILKENRSKEVRGDSLPEKVDDFRSRKKVTM

SEQ ID NO: 28589 - protein, 356 aa, Homo sapiens
MGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQK

SEQ ID NO: 28590 - protein, 486 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERAVNDQVLLDAEYKQMQCDFQLLSEEKLVLENELQKLKDKEKTKPTNNRTKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQITAQSGRLIEKRC

SEQ ID NO: 28591 - protein, 486 aa, Homo sapiens; identical to SEQ ID NO: 28590

SEQ ID NO: 28592 - protein, 233 aa, Homo sapiens
MATPPFRLIRKMFSFKVSRWMGLACFRSLAASSPSIRQKKLMHKLQEEKAFREEMKIFREKIEDFREEMWTFRGKIHAFRGQILGFWEEERPFWEEEKTFWKEEKSFWEMEKSFREEEKTFWKKYRTFWKEDKAFWKEDNALWERDRNLLQEDKALWEEEKALWVEERALLEGEKALWEDKTSLWEEENALWEEERAFWMENNGHVAGEQMLEDGPHNANRGQRLLAFSRGRA

SEQ ID NO: 28593 - protein, 465 aa, Homo sapiens
METGFPAIMYPGSFIGGWGEEYLSWEGPGLPDFVFQQQPVESEAMHCSNPKSGVVLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 28594 - protein, 530 aa, Homo sapiens
MAAIKAVNSKAEVARARAALAVNICAARGLQDVLRTNLGPKGTMKMLVSGAGDIKLTKDGNVLLDEMQIQHPTASLIAKVATAQDDVTGDGTTSNVLIIGELLKQADLYISEGLHPRIIAEGFEAAKIKALEVLEEVKVTKEMKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK
